(12) United States Patent
Ayal et al.

(10) Patent No.: US 8,168,857 B2
(45) Date of Patent: May 1, 2012

(54) POLYNUCLEOTIDES AND POLYPEPTIDES INVOLVED IN PLANT FIBER DEVELOPMENT AND METHODS OF USING SAME

(75) Inventors: Sharon Ayal, Kiryat-Ekron (IL); Hagai Karchi, Moshav Sitriya-Doar-Na Emek Soreq (IL); Evgenia Gold, Kiryat-Gat (IL); Laura Bekerman, Kochav Yair (IL)

(73) Assignee: Evogene Ltd., Rechovot (IL)

( * ) Notice: Subject to any disclaimer, the term of this patent is extended or adjusted under 35 U.S.C. 154(b) by 10 days.

(21) Appl. No.: 12/448,359

(22) PCT Filed: Dec. 20, 2007

(86) PCT No.: PCT/IL2007/001590
§ 371 (c)(1),
(2), (4) Date: Jun. 18, 2009

(87) PCT Pub. No.: WO2008/075364
PCT Pub. Date: Jun. 26, 2008

(65) Prior Publication Data
US 2009/0293146 A1    Nov. 26, 2009

Related U.S. Application Data

(60) Provisional application No. 60/875,804, filed on Dec. 20, 2006.

(51) Int. Cl.
C12N 15/29    (2006.01)
C12N 15/82    (2006.01)
A01H 5/00     (2006.01)
(52) U.S. Cl. .................. 800/278; 435/419; 536/23.6
(58) Field of Classification Search ............... None
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,981,834 A | 11/1999 | John et al. |
| 6,080,914 A | 6/2000 | Conner |
| 6,313,375 B1 | 11/2001 | Jung et al. |
| 6,313,376 B1 | 11/2001 | Jung et al. |

(Continued)

FOREIGN PATENT DOCUMENTS

AU    2005229157    10/2005

(Continued)

OTHER PUBLICATIONS

Payne et al (1999, Development 126:671-682).*
Bowie et al, Science 247:1306-1310, 1990.*
McConnell et al, Nature 411 (6838):709-713, 2001.*
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.

(Continued)

Primary Examiner — Stuart F. Baum

(57) ABSTRACT

Isolated polynucleotides are provided. Each of the isolated polynucleotides comprise a nucleic acid sequence encoding a polypeptide having an amino acid sequence at least 80% homologous to SEQ ID NOs:130-258 and 536-791, wherein the polypeptide is capable of regulating cotton fiber development. Also provided are methods of using such polynucleotides for improving fiber quality and/or yield of a fiber producing plant, as well as methods of using such polynucleotides for producing plants having increased biomass/vigor/yield.

10 Claims, 7 Drawing Sheets
(7 of 7 Drawing Sheet(s) Filed in Color)

U.S. PATENT DOCUMENTS

| | | | |
|---|---|---|---|
| 6,359,196 | B1 | 3/2002 | Lok et al. |
| 6,392,122 | B1 | 5/2002 | Clendennen et al. |
| 6,403,862 | B1 | 6/2002 | Jiao et al. |
| 6,472,588 | B1 | 10/2002 | Haigler et al. |
| 6,670,528 | B1 | 12/2003 | Shinozaki et al. |
| 6,720,477 | B2 | 4/2004 | Da Costa e Silva et al. |
| 7,554,007 | B2 | 6/2009 | Ronen et al. |
| 7,812,218 | B2 | 10/2010 | Ronen et al. |
| 7,910,800 | B2 | 3/2011 | Karchi et al. |
| 2002/0049999 | A1 | 4/2002 | Allen et al. |
| 2002/0160378 | A1 | 10/2002 | Harper et al. |
| 2002/0170088 | A1 | 11/2002 | Wilkins |
| 2003/0005485 | A1 | 1/2003 | Ohlrogge et al. |
| 2003/0074697 | A1 | 4/2003 | Allen et al. |
| 2003/0084485 | A1 | 5/2003 | Zhu et al. |
| 2003/0162294 | A1 | 8/2003 | Verbruggen |
| 2003/0233670 | A1 | 12/2003 | Edgerton et al. |
| 2004/0006794 | A1 | 1/2004 | Wilkins |
| 2004/0031072 | A1 | 2/2004 | La Rosa et al. |
| 2004/0034888 | A1 | 2/2004 | Liu et al. |
| 2004/0123343 | A1 | 6/2004 | La Rosa et al. |
| 2004/0172684 | A1 | 9/2004 | Kovalic et al. |
| 2004/0181830 | A1 | 9/2004 | Kovalic et al. |
| 2006/0101543 | A1 | 5/2006 | Somerville et al. |
| 2006/0123505 | A1 | 6/2006 | Kikuchi et al. |
| 2006/0123516 | A1 | 6/2006 | Ronen et al. |
| 2006/0150283 | A1 | 7/2006 | Alexandrov et al. |
| 2006/0168684 | A1 | 7/2006 | Renz et al. |
| 2006/0174373 | A1 | 8/2006 | Gipmans et al. |
| 2006/0195943 | A1 | 8/2006 | Feldmann et al. |
| 2006/0206961 | A1 | 9/2006 | Cirpus et al. |
| 2006/0260002 | A1 | 11/2006 | Ronen et al. |
| 2006/0288451 | A1 | 12/2006 | Val et al. |
| 2007/0006345 | A1 | 1/2007 | Alexandrov et al. |
| 2007/0006346 | A1 | 1/2007 | Alexandrov et al. |
| 2007/0044172 | A1 | 2/2007 | Schneeberger et al. |
| 2007/0061916 | A1 | 3/2007 | Kovalic et al. |
| 2007/0169219 | A1 | 7/2007 | Nadzan et al. |
| 2007/0214517 | A1 | 9/2007 | Alexandrov et al. |
| 2007/0261130 | A1 | 11/2007 | Lightner et al. |
| 2008/0076179 | A1 | 3/2008 | Hartel et al. |
| 2008/0148432 | A1 | 6/2008 | Abad |
| 2008/0196120 | A1 | 8/2008 | Wu et al. |
| 2008/0301839 | A1 | 12/2008 | Ravanello |
| 2009/0089898 | A1 | 4/2009 | Karchi et al. |
| 2009/0093620 | A1* | 4/2009 | Kovalic et al. ............... 536/23.1 |
| 2009/0126042 | A1 | 5/2009 | Ronen et al. |
| 2009/0260109 | A1 | 10/2009 | Ronen et al. |
| 2009/0293154 | A1 | 11/2009 | Yelin et al. |

FOREIGN PATENT DOCUMENTS

| | | |
|---|---|---|
| AU | 2005234725 | 12/2005 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| JP | 2005-052114 | 3/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/053055 | 6/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2008/069878 | 6/2008 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |

OTHER PUBLICATIONS

Invitation to Pay Additional Fees Dated Feb. 7, 2008 From the International Searching Authority Re.: Application No. PCT/IL06/001223.

Invitation to Pay Additional Fees Dated Dec. 18, 2008 From the international Searching Authority Re.: Application No. PCT/IL08/01024.

Communication Pursuant to Article 94(3) EPC Dated Sep. 9, 2009 From the European Patent Office Re.: Application No. 04734072.4.

Communication Pursuant to Article 94(3) EPC Dated May 12, 2010 From the European Patent Office Re.: Application No. 06766224.7.

Communication Pursuant to Article 94(3) EPC Dated Nov. 27, 2009 From the European Patent Office Re.: Application No. 06809784.9.

Communication Relating to the Results of the Partial International Search Dated Jul. 8, 2009 From the International Searching Authority Re.: Application No. PCT/IL2008/001657.

Examination Report Dated Nov. 13, 2007 From the Government of India, Patent Office Re.: Application No. 3482/CHENP/2005.

Examination Report Dated Feb. 17, 2010 From the Instituto Mexicano de la Propriedad Industrial Re. Application No. PA/a/2005/012565 and Its Summary in English.

International Preliminary Report on Patentability Dated Feb. 4, 2010 From the International Bureau of WIPO Re.: Application No. PCT/IL2008/001024.

International Preliminary Report on Patentability Dated Jul. 8, 2010 From the International Bureau of WIPO Re.: Application No. PCT/IL2008/001657.

International Preliminary Report on Patentability Dated Jan. 22, 2009 From the International Bureau of WIPO Re.: Application No. PCT/IL2006/000947.

International Search Report and the Written Opinion Dated Jul. 29, 2008 From the International Searching Authority Re.: Application No. PCT/IL06/001223.

International Search Report and the Written Opinion Dated Oct. 30, 2009 From the International Searching Authority Re.: Application No. PCT/IL2008/001657.

International Search Report Dated Mar. 4, 2009 From the International Searching Authority Re.: Application No. PCT/IL08/01024.

International Search Report Dated Nov. 4, 2005 From the International Searching Authority Re.: Application No. PCT/IL04/00431.

International Search Report Dated Aug. 27, 2008 From the International Searching Authority Re.: Application No. PCT/IL06/00947.

Invitation to Pay Additional Fees Dated Aug. 23, 2005 From the International Search Authority Re. Application No. PCT/IL2004/000431.

Office Action Dated Aug. 4, 2010 From the Israel Patent Office Re.: Application No. 172135 and Its Translation Into English.

Office Action Dated Jan. 9, 2009 From the State Intellectual Property Office of the People's Republic of China Re.: Application No. 200480020597.0.

Office Action Dated Jun. 17, 2010 From the Israel Patent Office Re. Application No. 190918 and Its Translation Into English.

Office Action Dated Apr. 27, 2009 From the Israeli Patent Office Re.: Application No. 172135 and Its Translation Into English.

Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Oct. 22, 2009 From the US Patent and Trademark Office Re.: U.S. Appl. No. 11/990,386.
Official Action Dated Jul. 28, 2008 From the US Patent and Trademark Office Re.: U.S. Appl. No. 11/284,236.
Response Dated Jan. 7, 2010 to Communication Pursuant to Article 94(3) EPC of Sep. 9, 2009 From the European Patent Office Re.: Application No. 04734072.4.
Response Dated Feb. 22, 2010 to Official Action of Oct. 22, 2009 From the US Patent and Trademark Office Re.: U.S. Appl. No. 11/990,386.
Response Dated Jun. 29, 2010 to Examination Report of Feb. 17, 2010 From the Instituto Mexicano de la Propriedad Industrial Re. Application No. PA/a/2005/012565.
Response Dated May 31, 2010 to Office Action of Jan. 31, 2010 From the Israel Patent Office Re.: Application No. 172135.
Supplementary European Search Report and the European Search Opinion Dated Feb. 1, 2010 From the European Patent Office Re.: Application No. 06766224.7.
Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of the Office Action Dated Jan. 9, 2009 From the State Intellectual Property Office Re.: Application No. 2004800200597.0.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/Il04/00431.
Written Opinion Dated Aug. 27, 2008 From the International Searching Authority Re.: Application No. PCT/IL06/00947.
Alcala et al. "Generation of ESTs From Tomato Fruit Tissue", Database GenBank on STIC, National Center for Biotechnology Information, Accession No. AW932839, 2001.
Brandle et al. "Perspectives on the Production of Recombinant Proteins in Plants", AgBiotechNet, 3(ABN 070): 1-4, 2001. Abstract.
Fray et al. "Nucleotide Sequence and Expression of A Ripening and Water Stress-Related cDNA From tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proceedings of the National Academy of Sciences USA, 101(25): 9205-9210, 2004.
Iiachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2-p .1153, col. 1, § 1, Table 1.

Hill et al. "Functional Analysis of Conserved Histidines in ADP-Glucose Pyrophosphorylase From *Escherichia coli*", Biochemical and Biophysical Research Communications, 244(2): 573-577, 1998.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Keskin et al. "A New, Structurally Nonredundant, Diverse Data Set of Protein-Protein Interfaces and Its Implications", Protein Science, 13: 1043-1055, 2004.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Liu et al. "Root-Specific Expression of A Western White Pine PR10 Gene Is Mediated by Different Promoter Regions in Transgenic Tobacco", Plant Molecular Biology, 52: 103-120, 2003.
Maurel "Plant Aquaporins: Novel Functions and Regulation Properties", FEBS Letters, XP022078418, 581(12): 2227-2236, May 25, 2007. p. 2230, col. 2, Last § -p. 2231, col. 1, § 2, Fig.1.
Nuccio et al. "Metabolic Engineering of Plants for Osmotic Stress Resistance", Current Opinion in Plant Biology, XP002216348, 2(2): 128-134, Apr. 1, 1999.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Sáez-Vásquez et al. "Accumulation and Nuclear Targeting of BnC24, A *Brassica napus* Ribosomal Protein Corresponding to A mRNA Accumulating in Response to Cold Treatment", Plant Science, 156(1): 35-46, 2000.
Smart et al. "MIP Genes Are Down-Regulated Under Drought Stress in *Nicotiana glauca*", Plant and Cell Physiology, 42(7): 686-693, 2001. Referent to Database Entry AF290618 on p. 686, p. 692, 1-h col. § 2.
Tamura et al. "Osmotic Stress Tolerance of Transgenic Tobacco Expressing A Gene Encoding A Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000.
Wells "Additivity of Mutational Effects in Proteins", Biochemistry, 29 (37): 8509-8517, 1990.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
Communication Pursuant to Article 94(3) EPC Dated Nov. 8, 2010 From the European Patent Office Re.: Application No. 04734072.4.
Communication Pursuant to Article 94(3) EPC Dated Nov. 19, 2010 From the European Patent Office Re.: Application No. 06809784.9.
Examination Report Dated Nov. 3, 2010 From the Government of India, Patent Office Re.: Application No. 158/CHENP/2007.
Examination Report Dated Sep. 22, 2010 From the Instituto Mexican de la Propriedad Industrial Re. Application No. MX/a/2008/005280 and Its Summary Into English.
International Search Report and the Written Opinion Dated Feb. 17, 2010 From the International Searching Authority Re.: Application No. PCT/IL09/00508.
Invitation to Pay Additional Fees Dated Nov. 19, 2009 From the International Searching Authority Re.: Application No. PCT/IL09/00508.
Office Action Dated Oct. 18, 2010 From the Israel Patent Office Re. Application No. 180022 and Its Translation Into English.

Yamada e tal. "*Arabidopsis thaliana* Clone RAFL14-87-A16 (R20399) Unknown Protein (At1g60770) mRNA, Complete Cds", GenBank Accession No. BT002876, Retrieved From the internet, Jan. 21, 2010.
International Preliminary Report on Patentability Dated Dec. 2, 2010 From the International Bureau of WIPO Re. Application No. PCT/IL2009/000508.
Notice of Allowance Dated Oct. 18, 2010 From the US Patent and Trademark Office Re.: U.S. Appl. No. 11/990,386.
Office Action Dated Nov. 11, 2010 From the Israel Patent Office Re. Application No. 206118 and Its Translation Into English.
Official Action Dated Nov. 23, 2010 From the US Patent and Trademark Office Re. U.S. Appl. No. 12/083,978.
Response Dated Dec. 5, 2010 to Office Action of Aug. 4, 2010 From the Israel Patent Office Re.: Application No. 172135.
Response Dated Dec. 12, 2010 to Examiner's Report of Dec. 17, 2009 From the Australian Patent Office Re.: Application No. 2005252469.
Response Dated Dec. 14, 2010 to Examination Report of Sep. 22, 2010 From the Instituto Mexicano de la Propriedad Industrial Re. Application No. MX/a/2008/005280.
Response Dated Sep. 14, 2010 to Official Action of Aug. 18, 2010 From the US Patent and Trademark Office Re. U.S. Appl. No. 12/083,978.
Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Summary of Office Action Dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Translation of Office Action Dated Oct. 19, 2010 From the State Intellectual Property Office of the People's Republic of China Re. Application No. 200680038391.X.
Wang et al. "Control of Plant Trichome Development by A Cotton Fiber MYB Gene", The Plant Cell, 16: 2323-2334, Sep. 2004.
Wang et al. "Control of Plant Trichome Development by A Cotton Fiber MYB Gene", The Plant Cell, 16: 2323-2334, Sep. 2004. GenEmbl Database, Accession No. AY641990.
Communication Pursuant to Article 94(3) EPC Dated Mar. 8, 2011 From the European Patent Office Re.: Application No. 06809784.9.
Communication Pursuant To Article 94(3) EPC Dated Mar. 14, 2011 From the European Patent Office Re. Application No. 07849616.3.
Response Dated Feb. 9, 2011 to Communication Pursuant to Article 94(3) EPC of Nov. 19, 2010 From the European Patent Office Re.: Application No. 06809784.9.
Response Dated Feb. 14, 2011 to Supplementary European Search Report and the European Search Opinion of Jul. 29, 2010 From the European Patent Office Re. Application No. 08776651.5.
Communciation Pursuant to Rules 70(2) and 70a(2) EPC Dated Aug. 30, 2011 From the European Patent Office Re. Application No. 08738191.9.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Feb. 24, 2011 to Communciation Pursuant to Rules 70(2) and 70a(2) EPC of Aug. 30, 2011 From the European Patent Office Re. Application No. 08738191.9.
International Search Report Dated Jul. 2, 2009 From the International Searching Authority Re.: Application No. PCT/IL07/01590.
Written Opinion Dated Jul. 2, 2009 From the International Searching Authority Re.: Application No. PCT/IL07/01590.
Orzaez et al. "Agroinjection of Tomato Fruits. A Tool for Rapid Functional Analysis of Transgenes Directly in Fruit", Plant Physiology, 140: 3-11, 2006.
Udall et al. "A Global Assembly of Cotton ESTs", Genome Research, 16(3): 441-450, 2006.
International Preliminary Report on Patentability Dated Jan. 21, 2010 From the International Bureau of WIPO Re.: Application No. PCT/IL2007/001590.

Notice of Grant Dated Jan. 14, 2011 From the Instituto Mexicano de la Propriedad Industrial Re. Application No. MX/a/2008/005280.
Examiner's Report Dated Jan. 13, 2011 From the Australian Patent Office Re.: Application No. 2005252469.
Response Dated Jan. 19, 2011 to Supplementary European Search Report and the European Search Opinion of Jul. 1, 2010 From the European Patent Office Re. Application No. 07849616.3.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Li et al. "Isolation of Genes Preferntially Expressed in Cotton Fibers by cDNA Filter Arrays and RT-PCR", Plant Science, 163: 1113-1120, 2002. & GenBank Nucleotide "*Gossypium hirsutum* Dehydration-Iduced Protein RD22-Like Protein (RDL0 mRNA, Complete CDS", GenBank Accession No. AY072821, Dec. 4, 2002.
International Preliminary Report on Patentability Dated Mar. 3, 2011 From the International Bureau of WIPO Re.: Application No. PCT/IB2009/053633.
International Search Report and the Written Opinion Dated Jun. 2, 2010 From the International Searching Authority Re. Application No. PCT/IB09/53633.
Invitation to Pay Additional Fees Dated Mar. 2, 2010 From the International Searching Authority Re.: Application No. PCT/IB09/53633.
Response Dated Oct. 12, 2010 to Communication Pursuant to Article 94(3) EPC of May 12, 2010 From the European Patent Office Re.: Application No. 06766224.7.
Response Dated Oct. 14, 2010 to Office Action of Jun. 17, 2010 From the Israel Patent Office Re. Application No. 190918.
Examiner's Report Dated Dec. 17, 2009 From the Australian Patent Office Re.: Application No. 2005252469.
International Preliminary Report on Patentability Dated Jan. 14, 2010 From the International Bureau of WIPO Re.: Application No. PCT/IL2008/000489.
International Preliminary Report on Patentability Dated Mar. 29, 2007 From the International Bureau of WIPO Re.: Application No. PCT/IL/2005/000627.
International Preliminary Report on Patentability Dated Jan. 30, 2007 From the International Bureau of WIPO Re.: Application No. PCT/IL05/00627.
International Search Report and the Written Opinion Dated Nov. 24, 2008 From the International Searching Authority Re.: Application No. PCT/IL08/00489.
International Search Report Dated Jan. 3, 2007 From the International Searching Authority Re.: Application No. PCT/IL2005/000627.
Invitation to Pay Additional Fees Dated Sep. 8, 2006 From the International Searching Authority Re.: Application No. PCT/IL05/00627.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Office Action Dated May 13, 2010 From the Israel Patent Office Re. Application No. 180022 and Its Translation Into English.
Office Action Dated Jan. 22, 2010 From the State Intellectual Property Office of the People's Republic of China Re.: Application No. 200580027481.4 and Its Translation Into English.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jun. 8, 2010 From the US Patent and Trademark Office Re.: U.S. Appl. No. 11/629,411.
Partial European Search Report Dated Apr. 19, 2010 From the European Patent Office Re.: Application No. 09163033.5.
Response Dated Sep. 21, 2010 to Notice of Allowance of Apr. 16, 2010 From the US Patent and Trademark Office Re.: U.S. Appl. No. 11/629,411.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
François et al. "Overexpression of the VvL, TP1 Gene Interferes With Somatic Embryo Development in Grapevine", Functional Plant Biology, 35(5): 394-402, 2008.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Merriam-Webster "Exogenous Definition", Merrian-Webster On-Line Dictionary, 2010.
Decision on Granting A Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
Office Action Dated Feb. 3, 2011 From the Israel Patent Office Re.: Application No. 172135 and Its Translation Into English.
Response Dated Sep. 13, 2010 to Office Action Dated May 13, 2010 From the Israel Patent Office Re. Application No. 180022.
Communication Pursuant to Rule 70(2) EPC and Reference to Rule 39(1) EPC Dated Sep. 13, 2010 From the European Patent Office Re.: Application No. 09163033.5.
Supplementary European Search Report and the European Search Opinion Dated Jul. 1, 2010 From the European Patent Office Re. Application No. 07849616.3.
Communication Pursuant to Article 94(3) EPC Dated Feb. 13, 2009 From the European Patent Office Re.: Application No. 05750089.4.
European Search Report and the European Search Opinion Dated Aug. 9, 2010 From the European Patent Office Re.: Application No. 09163033.5.
International Preliminary Report on Patentability Dated Mar. 29, 2007 From the International Bureau of WIPO Re.: Application No. PCT/IL2005/000627.
Response Dated Jan. 4, 2010 to Official Action of Sep. 2, 2009 From the US Patent and Trademark Office Re.: U.S. Appl. No. 11/629,411.
Response Dated May 17, 2010 to Office Action of Jan. 22, 2010 From the State Intellectual Property Office of the People's Republic of China Re.: Application No. 200580027481.4.
Supplementary European Search Report and the European Search Opinion Dated Aug. 11, 2010 From the European Patent Office Re. Application No. 08738191.9.
Supplementary European Search Report Dated Apr. 23, 2008 From the European Patent Office Re.: Application No. 05750089.4.
Translation of Notice of Payment of the Restoration Fee for Unity of Invention Dated Mar. 20, 2009 From the State Intellectual Property Office of the People's Republic of China Re.: Application No. 200580027481.4.
Written Opinion Dated Jan. 3, 2007 From the International Searching Authority Re.: Application No. PCT/IL2005/000627.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Bowie et al. "Deciphering the Message in Protein Sequences: Tolerance to Amino Acid Substitutions", Science, 247(4948): 1306-1310, Mar. 16, 1990.

Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
François et al. "Overexpression of the VvLTP1 Gene Interferes With Somatic Embryo Development in Grapevine", Functional Plant Biology, 35(5): 394-402, 2008.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kirubakaran et al. "Characterization of a New Antifungal Lipid Transfer Protein From Wheat", Plant Physiology and Biochemistry, 46: 918-927, 2008.
McConnell et al. "Role of *Phabulosa* and *Phavoluta* in Determining Radial Patterning in Shoots", Nature, 411(6338): 709-713, Jun. 7, 2001.
NCBI "Protein Sequence (588 Letters)", NCBI BLAST Basic Local Alignment Search Tool, 3 P., Retrieved From the Internet on Nov. 24, 2009.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Wallace et al. "Oligonucleotide Probes for the Screening of Recombinant DNA Libraries", Methods in Enzymology, XP002957829, 152: 432-442, Jan. 1, 1987.
Wing et al. "An Integrated Analysis of the Genetics, Devlopment, and Evolution of Cotton Fiber", NBCI GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Examiner's Report Dated Mar. 31, 2011 From the Australian Government, IP Australia Re.: Application No. 2005252469.
Response Dated Mar. 8, 2011 to Examiner's Report of Jan. 13, 2011 From the Australian Government, IP Australia Re.: Application No. 2005252469.
Response Dated Mar. 9, 2011 to Office Action of Nov. 11, 2010 From the Israel Patent Office Re. Application No. 206118.
Response Dated Mar. 23, 2011 to Official Action of Nov. 23, 2010 From the US Patent and Trademark Office Re. U.S. Appl. No. 12/083,978.
Response Dated Mar. 24, 2011 to Examination Report of Nov. 3, 2010 From the Government of India, Patent Office Re.: Application No. 158/CHENP/2007.
Official Action Dated May 10, 2011 From the US Patent and Trademark Office Re. U.S. Appl. No. 12/457,199.
Response Dated Apr. 21, 2011 to Communication Pursuant to Article 94(3) EPC of Nov. 8, 2010 From the European Patent Office Re.: Application No. 04734072.4.
Supplementary European Search Report and the European Search Opinion Dated May 6, 2011 From the European Patent Office Re. Application No. 09750276.9.
Sunkar et al. "Small RNAs as Big Players in Plant Abiotic Stress Responses and Nutrient Deprivation", Trends in Plant Science XP022148764, 12(7): 301-309, Jul. 1, 2007.
Communication Pursuant to Rules 70(2) and 70a(2) EPC Dated May 24, 2011 From the European Patent Office Re. Application No. 09750276.9.
Examination Report Dated Apr. 19, 2011 From the Instituto Mexican de la Propriedad Industrial Re. Application No. MX/a/2008/002262 and Its Summary Into English.
European Search Report and the European Search Opinion Dated Nov. 2, 2011 From the European Patent Office Re. Application No. 10194223.3.
Examiner's Report Dated Oct. 19, 2011 From the Australian Government, IP Australia Re. Application No. 2006281018.
Examiner's Report dated Oct. 28, 2011 From the Australian Government, IP Australia re. Application No. 2006307457.

International Search Report and the Written Opinion Dated Oct. 31, 2011 From the International Searching Authority Re.: Application No. PCT/IL08/00489.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Response Dated Oct. 18, 2011 to Official Action of Sep. 19, 2011 From the US Patent and Trademark Office Re. U.S. Appl. No. 12/810,855.
Ji et al. "*Gossypium hirsutum* Expansin mRNA, Complete CDs", Database EMBL [Online], XP002474936, Retrieved From EBI Accession No. EMBL:AY189969, Database Accession No. AY189969, May 20, 2003.
Ngo et al. "Computational Complexity, Protein Structure Prediction, and the Levinthal Paradox", The Protein Folding Problem and Tertiary Structure Prediction, p. 433, 492-495, 1994.
Smart et al. "*Nicotiana glauca* Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.
Van der Hoeven et al. "EST301294 Tomato Root During/After Fruit Set, Cornell University *Lycopersicon esculentum* cDNA Clone cLEXIK11 Similar to *Vernicia fordii* Aquaporin, mRNA Sequence", Database EMBL [Online], Retrieved From EBI Accession No. EMBL: AW218814, XP002455680, Database Accession No. AW218814, Dec. 14, 1999. Abstract.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218815, XP002455681, Database Accession No. AW218815, Dec. 14, 1999. Abstract.
Communication Pursuant to Article 94(3) EPC Dated Jun. 29, 2011 From the European Patent Office Re. Application No. 08738191.9.
Response Dated Jun. 2, 2011 to Office Action of Feb. 3, 2011 From the Israel Patent Office Re.: Application No. 172135.
Examiner's Report Dated Dec. 20, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
Office Action Dated Jun. 19, 2011 From the Israel Patent Office Re. Application No. 199391 and Its Translation Into English.
Response Dated Jun. 9, 2011 to Examiner's Report of Dec. 20, 2011 From the Australian Government, IP Australia Re. Application No. 2005234725.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Office Action Dated Jun. 20, 2011 From the Israel Patent Office Re. Application No. 190918 and Its Translation into English.
Partial European Search Report Dated Jul. 12, 2011 From the European Patent Office Re. Application No. 10194223.3.

Response Dated Jun. 15, 2011 to Examiner's Report of Mar. 31, 2011 From the Australian Government, IP Australia Re.: Application No. 2005252469.
Li et al. "*Gossypium hirsutum* Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Official Action Dated Jul. 8, 2011 From the US Patent and Trademark Office Re. U.S. Appl. No. 12/083,978.
Response Dated Jun. 17, 2011 to Examiner's Report of Mar. 31, 2011 From the Australian Government, IP Australia Re.: Application No. 2005252469.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Examiner's Report Dated Jul. 21, 2011 From the Australian Government, IP Australia Re. Application No. 2005234725.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Jun. 6, 2011 to Official Action of May 10, 2011 From the US Patent and Trademark Office Re. U.S. Appl. No. 12/457,199.
Response Dated Jul. 25, 2011 to Examiner's Report of Jul. 21, 2011 From the Australian Government, IP Australia Re. Application No. 2005234725.
Examination Report Dated Aug. 1, 2011 From the Government of India, Patent Office Re.: Application No. 158/CIIENP/2007.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Response Dated Jul. 6, 2011 to Examiner's Report of Dec. 20, 2010 From the Australian Government, IP Australia Re. Application No. 2005234725.
Response Dated Jul. 20, 2011 to Examination Report of May 25, 2011 From the Government of India, Patent Office Re.: Application No. 158/CHENP/2007.
Translation of Notification of the First Office Action Dated Jun. 30, 2011 From the State Intellectual Property Office of the People's Republic of China Re. Application No. 200680047610.0.
International Search Report and the Written Opinion Dated Sep. 7, 2010 From the International Searching Authority Re. Application No. PCT/IB10/50871.
Invitation to Pay Additional Fees Dated Jun. 9, 2011 From the International Searching Authority Re. Application No. PCT/IB10/56023.
Apse et al. "Engineering Salt Tolerance in Plants", Current Opinion in Biotechnology, 13: 146-150, 2002.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.

Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.

Hattori et al. "An Acetohydroxy Acid Synthase Mutant Reveals a Single Site Involved in Multiple Herbicide Resistance", Molecular and General Genetics, 246: 419-425, 1995. Abstract!

Holmström et al. "Drought Tolerance in Tobacco", Nature, 379: 683-684, 1996. Abstract!

Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!

Pilon-Smits et al. "Improved Performance of Transgenic Fructan-Accumulating Tobacco under Drought Stress", Plant Physiology, 107: 125-130, 1995.

Quesada et al. "Genetic Architecture of NaCl Tolerance in *Arabidopsis*", Plant Physiology, 130: 951-963, 2002. Abstract!

Saijo et al. "Over-Expression of a Single Ca 2+-Dependent Protein Kinase Confers Both Cold and Salt/Drought Tolerance on Rice Plants", The Plant Journal 23(3): 319-327, 2000.

Skriver et al. "Cis-Acting DNA Elements Responsive to Gibberellin and Its Antagonist Abscisic Acid", Proceedings of the National Academy of Sciences USA 88: 7266-7270, 1991.

Tarczynski et al. "Stress Protection of Transgenic Tobacco by Production of the Osmolyte Mannitol", Science, 259: 508-510, 1993. Abstract!

van Haaren et al. "A Functional Map of the Fruit-Specific Promoter of the Tomato 2A11 Gene", Plant Molecular Biology, 21: 625-640, 1993. Abstract!

Vigeolas et al. "Increasing Seed Oil Content in Oil-Seed Rape (*Brassica Napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!

Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!

Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.

Yanagisawa et al. "Diversity and Similarity Among Recognition Sequences of Dof Transcription Factors", The Plant Journal, 17(2): 209-214, 1999.

Zabrouskov et al. "Oxidative Metabolism and the Physiological Age of Seed Potatoes Are Affected by Increased Alpha-Linolenate Content", Physiologia Plantarum, 116: 172-185, 2002.

Official Action Dated Sep. 19, 2011 From the US Patent and Trademark Office Re. U.S. Appl. No. 12/810,855.

Response Dated Sep. 25, 2011 to Examiner's Report of Jun. 30, 2011 From the Australian Government, IP Australia Re. Application No. 2006307457.

European Search Report and the European Search Opinion Dated Oct. 6, 2011 From the European Patent Office Re. Application No. 11172514.9.

Response Dated Oct. 3, 2011 to Examiner's Report of Jun. 24, 2011 From the Australian Government, IP Australia Re. Application No. 2006281018.

Response Dated Oct. 4, 2011 to Official Action of Jul. 8, 2011 From the US Patent and Trademark Office Re. U.S. Appl. No. 12/083,978.

Office Action Dated Sep. 22, 2011 From the Israeli Patent Office Re. Application No. 201242 and Its Translation Into English.

Response Dated Oct. 17, 2011 to Requisition by the Examiner of Jun. 15, 2011 From the Canadian Intellectual Property Office Re. Application No. 2,526,440.

Chames et al. "Direct Selection of a Human Antibody Fragment Directed Against the Tumor T-Cell Epitope HLA-Al-MAGE-Al From A Nonimmunized Phage-Fab Library", Proc. Natl. Acad. Sci. USA, PNAS, XP002967292, 97(14): 7969-7974, Jul. 5, 2000.

International Preliminary Report on Patentability Dated Sep. 15, 2011 From the International Bureau of WIPO Re. Application No. PCT/IB2010/050871.

Official Action Dated Aug. 22, 2011 From the US Patent and Trademark Office Re. US. Appl. No. 12/457,199.

Johansson et al. "The Role of Aquaporins in Cellular and Whole Plant Water Balance," Biochimica et Biophysica Acta 1465: 324-342, 2000.

Whisstock et al. "Prediction of Protein Function from Protein Sequence and Structure," Quarterly Reviews of Biophysics 36 (3): 307-340, Aug. 2003.

Requisition by the Examiner Dated Jun. 15, 2011 From the Canadian Intellectual Property Office Re. Application No. 2,526,440.

* cited by examiner

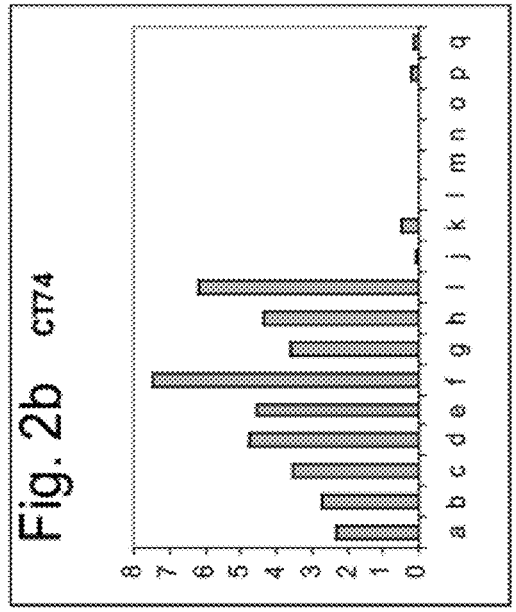
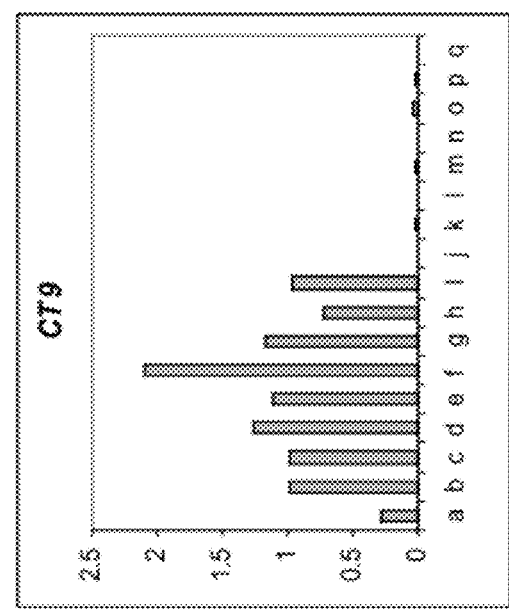
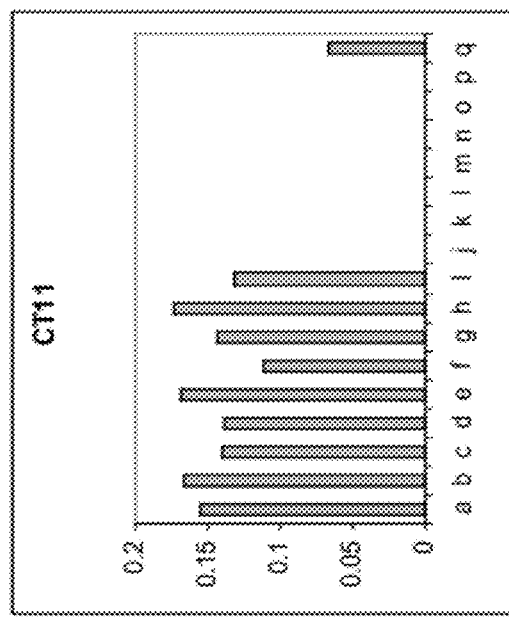

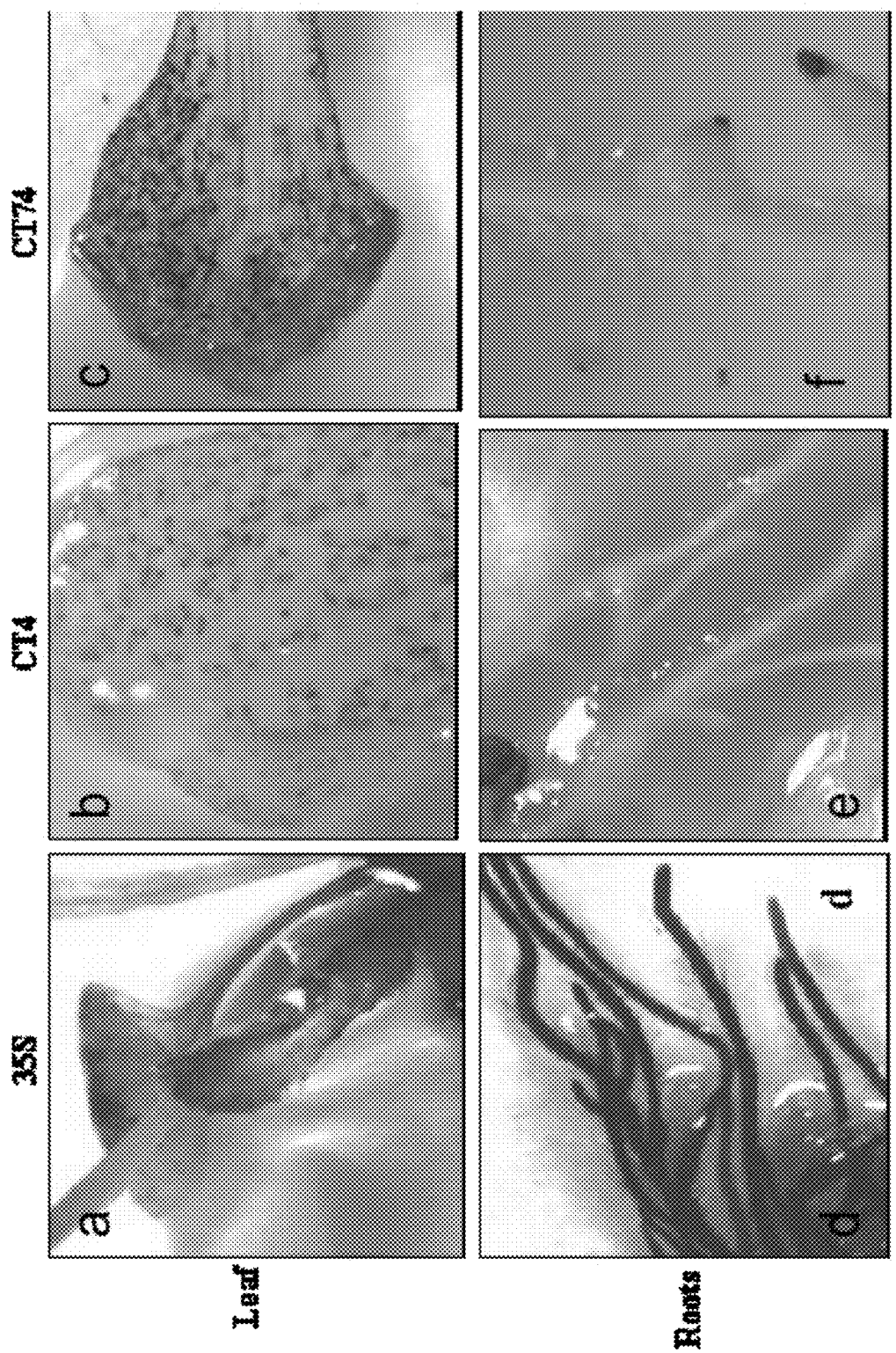
Figs. 3a-f

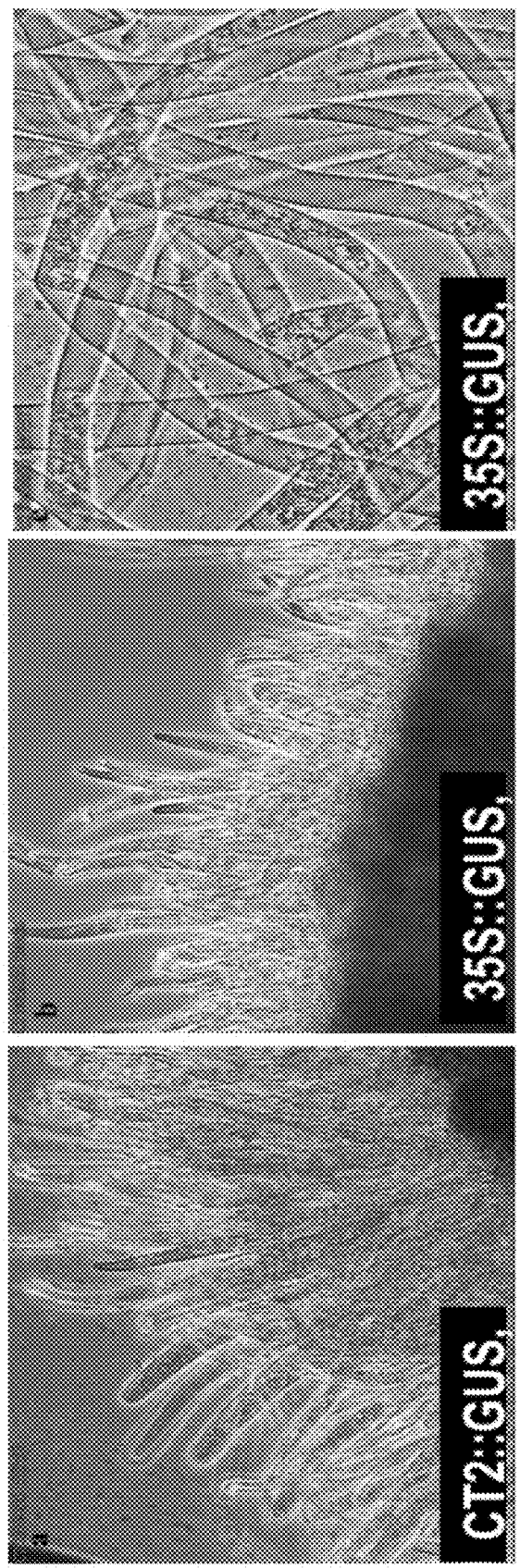
Fig. 4a CT2::GUS.
Fig. 4b 35S::GUS.
Fig. 4c 35S::GUS.

US 8,168,857 B2

POLYNUCLEOTIDES AND POLYPEPTIDES INVOLVED IN PLANT FIBER DEVELOPMENT AND METHODS OF USING SAME

RELATED APPLICATIONS

This Application is a National Phase of PCT Patent Application No. PCT/IL2007/001590 having International filing date of Dec. 20, 2007, which claims the benefit of U.S. Provisional Patent Application No. 60/875,804 filed on Dec. 20, 2006. The contents of the above Applications are all incorporated herein by reference.

FIELD AND BACKGROUND OF THE INVENTION

The invention, in some embodiments thereof, relates to polynucleotides and polypeptides involved in plant-fiber development and methods of using same.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop. In spite of the growth of synthetic fibers in the last 50 years, cotton still accounts for approximately 50% of the world's textile fiber. Even though 90% of cotton's value as a crop resides in the fiber (lint), yield and fiber quality has declined, especially over the last decade. This decline has been attributed to general erosion in genetic diversity of cotton varieties, and an increased vulnerability of the crop to environmental conditions.

Cotton fibers can be obtained from many varieties of cotton with a range of characteristics for various applications. Cotton fibers may be characterized according to a variety of properties, some of which are considered highly desirable within the textile industry for the production of increasingly high quality products and optimal exploitation of modern spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

Several approaches can be used to improve the characteristics or yield of cotton fibers. Variety improvement of cultivated cotton plants has been performed by cross breeding. However, breeding is relatively slow and inefficient, and the degree of variability which can be achieved is limited to the existing genetic diversity. In addition, plants can be treated with hormones such as auxin, gibberellin, cytokinin, ethylene or brassinolide [see e.g. U.S. Pat. No. 5,880,110]. However, no measurable effect of the hormones has been documented, making practical use of these hormones on a large scale highly unlikely. Alternatively, variety improvement can be achieved by genetic engineering. In recent years, a remarkable progress has been made in plant genetic engineering with the successful variety improvement of commercially important crop plants such as cotton, soybean, corn, and canola. The broad acceptance of genetically engineered cotton in the leading producing countries make it an attractive candidate for genetic engineering for improvement of fiber yield and/or quality. For example, introducing a gene coding for an insecticidal protein toxin produced *Bacillus thuringiensis* (BT) into a cotton plant has improved insect resistance. In addition, cotton plants with improved herbicide (Glyphosate) resistance have been genetically engineered by the introduction of a gene coding for 5-enol-pyruvil-shikimic acid 3-phosphate synthetase.

A cotton fiber is composed of a single cell that has differentiated from an epidermal cell of the seed coat, developing through four chronological stages, i.e., initiation, elongation, secondary cell wall thickening and maturation stages. The elongation of a cotton fiber commences in the epidermal cell of the ovule immediately following flowering, after which the cotton fiber rapidly elongates for approximately 21 days. Fiber elongation is then terminated, and a secondary cell wall is formed and grows through maturation to become a mature cotton fiber.

Little is known about the genetic control of cotton fiber initiation and elongation. Since both cotton fibers and *Arabidopsis* trichomes are developed from single epidermal cells it was suggested that they both share similar genetic regulation (Reviewed at Wagner G. J. et. al. 2004). In *Arabidopsis*, a large number of studies have revealed extensive information on the genetic mechanisms regulating trichome initiation and elongation. Several studies demonstrated the similarities between trichome and fiber by showing that cotton fiber specific promoters confer trichome specific expression in *arabidopsis* and tobacco plants (Kim and Triplett, 2001; Hsu et. al. 1999; Liu et. al. 2000, Wang et al. 2004). Most of the research that studies fiber development uses *arabidopsis* trichome as a model system to identify cotton genes in a small scale manner (Kim and Triplett, 2001; Wang et al. 2004).

Several candidate genes associated with the elongation and formation of cotton fibers have been identified. For example, five genes from cotton plants which are specifically expressed at the cotton fiber elongation stage were identified by differential screening and display methods [U.S. Pat. No. 5,880,100 and U.S. Pat. Nos. 5,932,713, 6,225,536 and 6,166,294].

WO0245485 describes methods and means to modulate fiber quality in fiber-producing plants, such as cotton, by modulating sucrose synthase (a sugar important for cell wall synthesis) activity and/or expression in such plants.

U.S. Pat. No. 6,472,588 and WO01/7333 provide methods of increasing the quality of cotton fiber (e.g., strength, length, fiber maturity ratio, immature fiber content, fiber uniformity or micronaire) by transforming a cotton plant with a DNA encoding sucrose phosphate synthase.

WO9508914 discloses a fiber producing plant comprising in its genome a heterologous genetic construct which includes a fiber-specific promoter and a coding sequence encoding a plant peroxidase, such as a cotton peroxidase.

WO9626639 provides a method utilizing an ovary specific promoter sequence to express plant growth modifying hormones in cotton ovule tissue. The method permits the modification of the characteristics of boll set in cotton plants and provides a mechanism for altering fiber quality characteristics such as fiber dimension and strength.

U.S. Pat. No. 5,981,834, U.S. Pat. No. 5,597,718, U.S. Pat. No. 5,620,882, U.S. Pat. No. 5,521,708 and U.S. Pat. No. 5,495,070 disclose a method of genetically engineering a fiber-producing plant and the identification of cDNA clones useful for identifying fiber genes in cotton.

U.S. patent applications 2002049999 and 2003074697 disclose cotton plants of the genus *Gossypium* expressing endoxyloglucan transferase, catalase or peroxidase with improved cotton fiber characteristics.

WO 01/40250 provides a method of improving cotton fiber quality by modulating transcription factor gene expression.

WO 96/40924 provides novel DNA constructs which may be used as molecular probes or alternatively inserted into a plant host to modify transcription of a DNA sequence-of-interest during various stages of cotton fiber development.

EP0834566 discloses a gene which controls the fiber formation mechanism in a cotton plant.

Validation of genes which improve cotton fiber yield and quality in vivo requires a reliable model system for cotton fiber development. Models in other plant platforms, such as trichome cells and root hairs, are widely accepted for cotton fiber development. However measuring changes in growth rate, cell length and thickness is not easy because of the small size, difficult access to and lack of uniformity in sizes. The present inventors have analyzed tomato seed hairs for their possible use as a model tissue for cotton fiber development (WO2005/121364 which is incorporated herein by reference) and demonstrated a high correlation between tomato seed hair and cotton fiber.

The generation of stably transformed transgenic plants to assess gene function is a lengthy manipulative process. As an alternative, foreign gene expression in plants is often performed using transient transformation of cells or tissues. *Agrobacterium* mediated transient gene expression (agroinfiltration) in plant leaves has become the favorite choice in many gene functional analyses (Kapila et al., 1997; Yang et al., 2000; Goodin et al., 2002). There are existing protocols for transient gene expression in tissue-culture grown cotton fibers [such as Kim H J, et al., 2001]. Orzaez D., et al. 2006, developed an agroinfiltration-based system (agroinjection), which allows transient expression of foreign genes directly in tomato fruit tissues.

SUMMARY OF THE INVENTION

According to an aspect of some embodiments of the invention there is provided an isolated polynucleotide comprising a nucleic acid sequence encoding a polypeptide having an amino acid sequence at least 80% homologous to an amino acid sequence selected from the group consisting of SEQ ID NOs:130, 141, 131, 146, 139, 140, 137, 133, 136, 135, 134, 132, 138, 142, 143, 144, 145, 147-258 and 536-791, wherein the polypeptide is capable of regulating fiber development.

According to an aspect of some embodiments of the invention there is provided an isolated polypeptide comprising an amino acid sequence at least 80% homologous to an amino acid sequence selected from the group consisting of SEQ ID NOs:130, 141, 131, 146, 139, 140, 137, 133, 136, 135, 134, 132, 138, 142, 143, 144, 145, 147-258 and 536-791, wherein the polypeptide is capable of regulating fiber development According to an aspect of some embodiments of the invention there is provided an isolated polynucleotide comprising a nucleic acid sequence at least 95% identical to SEQ ID NO:851, 848, 857, or 854, wherein the nucleic acid sequence is capable of regulating an expression of a heterologous polynucleotide sequence operably linked thereto.

According to an aspect of some embodiments of the invention there is provided a nucleic acid construct comprising the isolated polynucleotide.

According to an aspect of some embodiments of the invention there is provided a nucleic acid construct comprising the isolated polynucleotide and a heterologous nucleic acid sequence operably attached thereto.

According to an aspect of some embodiments of the invention there is provided a transgenic cell comprising the isolated polynucleotide.

According to an aspect of some embodiments of the invention there is provided a transgenic cell exogenously expressing the isolated polypeptide.

According to an aspect of some embodiments of the invention there is provided a transgenic plant comprising the isolated polynucleotide.

According to an aspect of some embodiments of the invention there is provided a transgenic plant exogenously expressing the isolated polypeptide.

According to an aspect of some embodiments of the invention there is provided a method of increasing a biomass of a plant, the method comprising exogenously expressing the isolated polypeptide in the plant, thereby increasing the biomass of the plant.

According to an aspect of some embodiments of the invention there is provided a method of increasing a vigor of a plant, the method comprising exogenously expressing the isolated polypeptide in the plant, thereby increasing the vigor of the plant.

According to an aspect of some embodiments of the invention there is provided a method of increasing a yield of a plant, the method comprising exogenously expressing the isolated polypeptide in the plant, thereby increasing the yield of the plant.

According to an aspect of some embodiments of the invention there is provided a method of increasing a tolerance of a plant to abiotic stress, the method comprising exogenously expressing the isolated polypeptide in the plant, thereby increasing the tolerance of the plant to abiotic stress.

According to an aspect of some embodiments of the invention there is provided a method of improving fiber quality and/or yield of a fiber producing plant, the method comprising exogenously expressing the isolated polypeptide in the fiber producing plant, thereby improving the quality and/or yield of the fiber producing plant.

According to an aspect of some embodiments of the invention there is provided a method of increasing a biomass of a plant, the method comprising expressing the nucleic acid construct in the plant, thereby increasing the biomass of the plant.

According to an aspect of some embodiments of the invention there is provided a method of increasing a vigor of a plant, the method comprising expressing the nucleic acid construct in the plant, thereby increasing the vigor of the plant.

According to an aspect of some embodiments of the invention there is provided a method of increasing a yield of a plant, the method comprising expressing the nucleic acid construct in the plant, thereby increasing the yield of the plant.

According to an aspect of some embodiments of the invention there is provided a method of producing cotton fibers, the method comprising: (a) generating a transgenic cotton plant exogenously expressing the isolated polypeptide; and (b) harvesting the fibers of the transgenic cotton plant, thereby producing the cotton fibers.

According to an aspect of some embodiments of the invention there is provided a nucleic acid construct comprising: (i) a first polynucleotide sequence which comprises a reporter gene operably linked to a fiber-specific promoter; and (ii) a second polynucleotide sequence which comprises a heterologous nucleic acid sequence encoding a polypeptide-of-interest operably linked to a promoter.

According to an aspect of some embodiments of the invention there is provided a nucleic acid construct system comprising: (i) a first nucleic acid construct which comprises a first polynucleotide sequence comprising a reporter gene operably linked to a fiber-specific promoter; and (ii) a second nucleic acid construct which comprises a second polynucleotide sequence comprising a heterologous nucleic acid sequence encoding a polypeptide-of-interest operably linked to a promoter.

According to an aspect of some embodiments of the invention there is provided a method of expressing a polypeptide-of-interest in a plant, comprising administering to the plant the nucleic acid construct or the nucleic acid construct system, thereby expressing the polypeptide-of-interest in the plant.

According to an aspect of some embodiments of the invention there is provided a method of expressing a polypeptide-of-interest in a cotton plant, comprising injecting to a cotton ball of the cotton plant a nucleic acid construct which comprises a nucleic acid sequence encoding the polypeptide-of-interest, there by expressing the polypeptide-of-interest in the cotton plant.

According to an aspect of some embodiments of the invention there is provided a cell comprising the nucleic acid construct or the nucleic acid construct system.

According to some embodiments of the invention, the nucleic acid sequence is selected from the group consisting of SEQ ID NOs:1, 12, 2, 17, 10, 11, 8, 4, 7, 6, 5, 3, 9, 13, 14, 15, 16, 18-129 and 259-535.

According to some embodiments of the invention, the polypeptide is selected from the group consisting of SEQ ID NOs:130, 141, 131, 146, 139, 140, 137, 133, 136, 135, 134, 132, 138, 142, 143, 144, 145, 147-258 and 536-791.

According to some embodiments of the invention, the isolated polynucleotide is as set forth by SEQ ID NO:851, 848, 857, or 854.

According to some embodiments of the invention, the nucleic acid sequence is shorter than 1800 bp.

According to some embodiments of the invention, the fiber comprises a cotton fiber.

According to some embodiments of the invention, the nucleic acid construct further comprises at least one cis-acting regulatory element operably linked to the isolated polynucleotide.

According to some embodiments of the invention, expressing is effected at a root tip of the plant.

According to some embodiments of the invention, the quality of the fiber producing plant comprises at least one parameter selected from the group consisting of fiber length, fiber strength, fiber weight per unit length, maturity ratio, uniformity and micronaire.

According to some embodiments of the invention, the fiber producing plant is selected from the group consisting of cotton, silk cotton tree, desert willow, creosote bush, winterfat, balsa, ramie, kenaf, hemp, roselle, jute, sisal abaca and flax.

According to some embodiments of the invention, the fiber development comprises fiber formation.

According to some embodiments of the invention, the fiber development comprises fiber elongation.

According to some embodiments of the invention, the plant is a cotton plant.

According to some embodiments of the invention, administering is effected by injecting the nucleic acid construct or the nucleic acid construct system to a cotton ball of the cotton plant.

According to some embodiments of the invention, the nucleic acid construct is comprised in *agrobacteria*.

According to some embodiments of the invention, expressing is effected in an ovule cell of the cotton plant.

According to some embodiments of the invention, the polypeptide-of-interest regulates fiber development.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
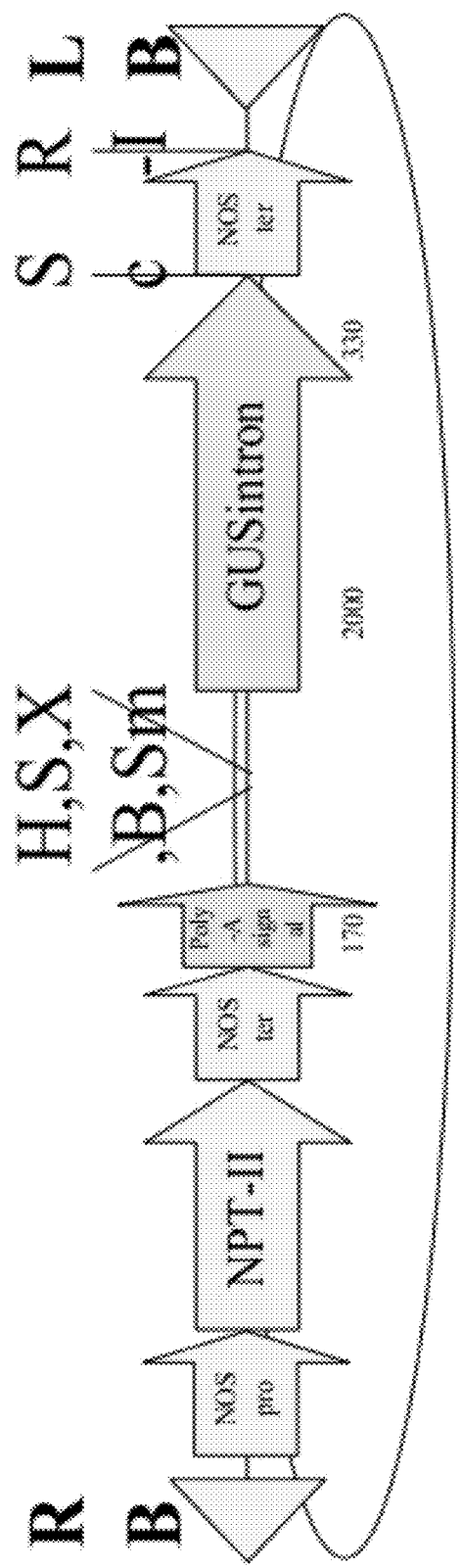

FIG. 1 is a schematic illustration of the pGI binary plasmid used for expressing the isolated polynucleotide sequences of the invention under the control of the 35S promoter. RB—T-DNA right border; LB—T-DNA left border; H—HindIII restriction enzyme; X—XbaI restriction enzyme; B—BamHI restriction enzyme; S—SalI restriction enzyme; Sm—SmaI restriction enzyme; R-I—EcoRI restriction enzyme; Sc—SacI/SstI/Ecl136II; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron) The isolated polynucleotide sequences of the invention were cloned into the vector while replacing the GUSintron reporter gene.

Figure 5B:
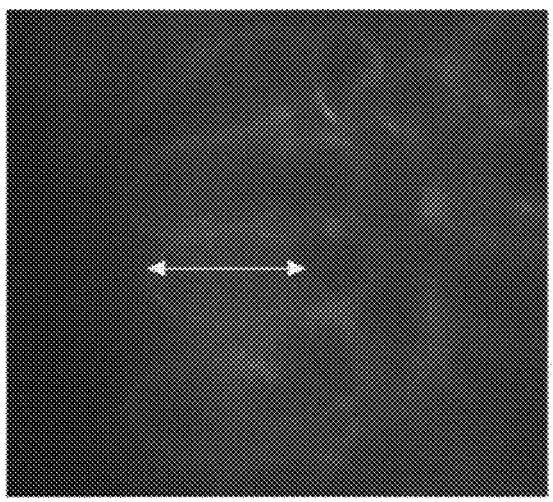
Figure 5A:
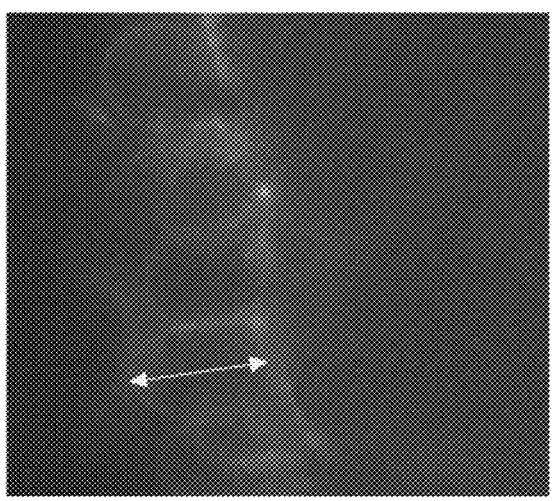
Figure 5C:
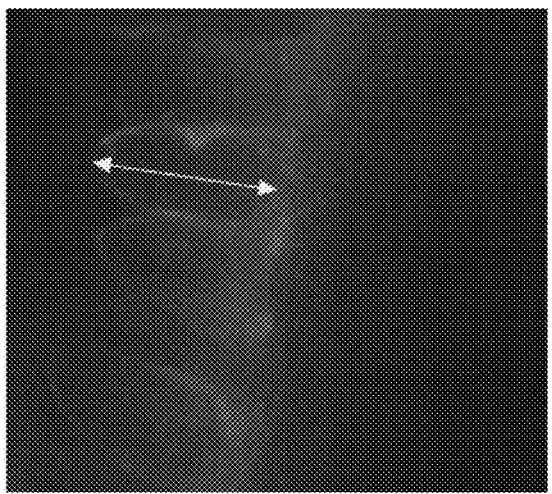
Figure 6:
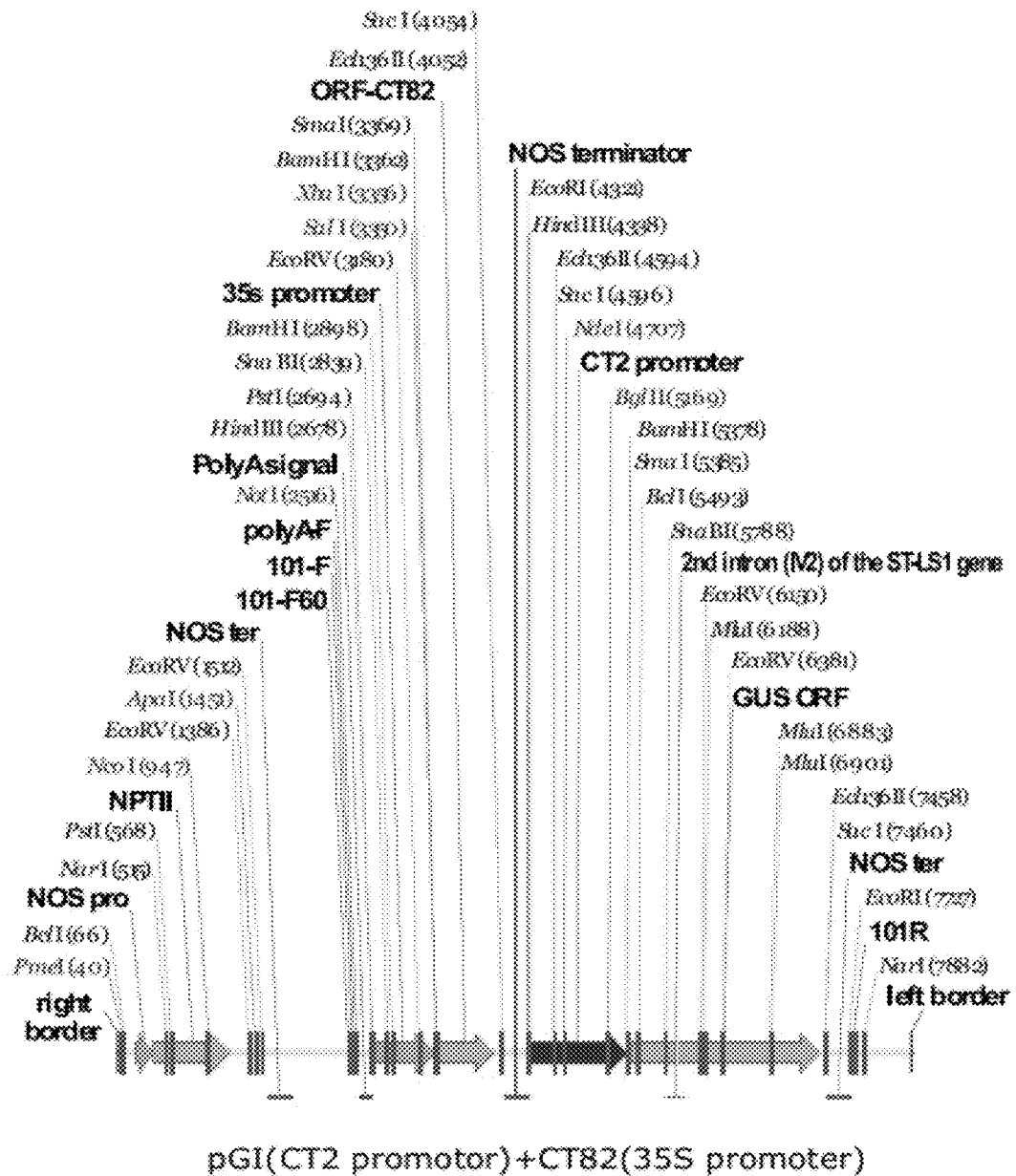
Figure 7:
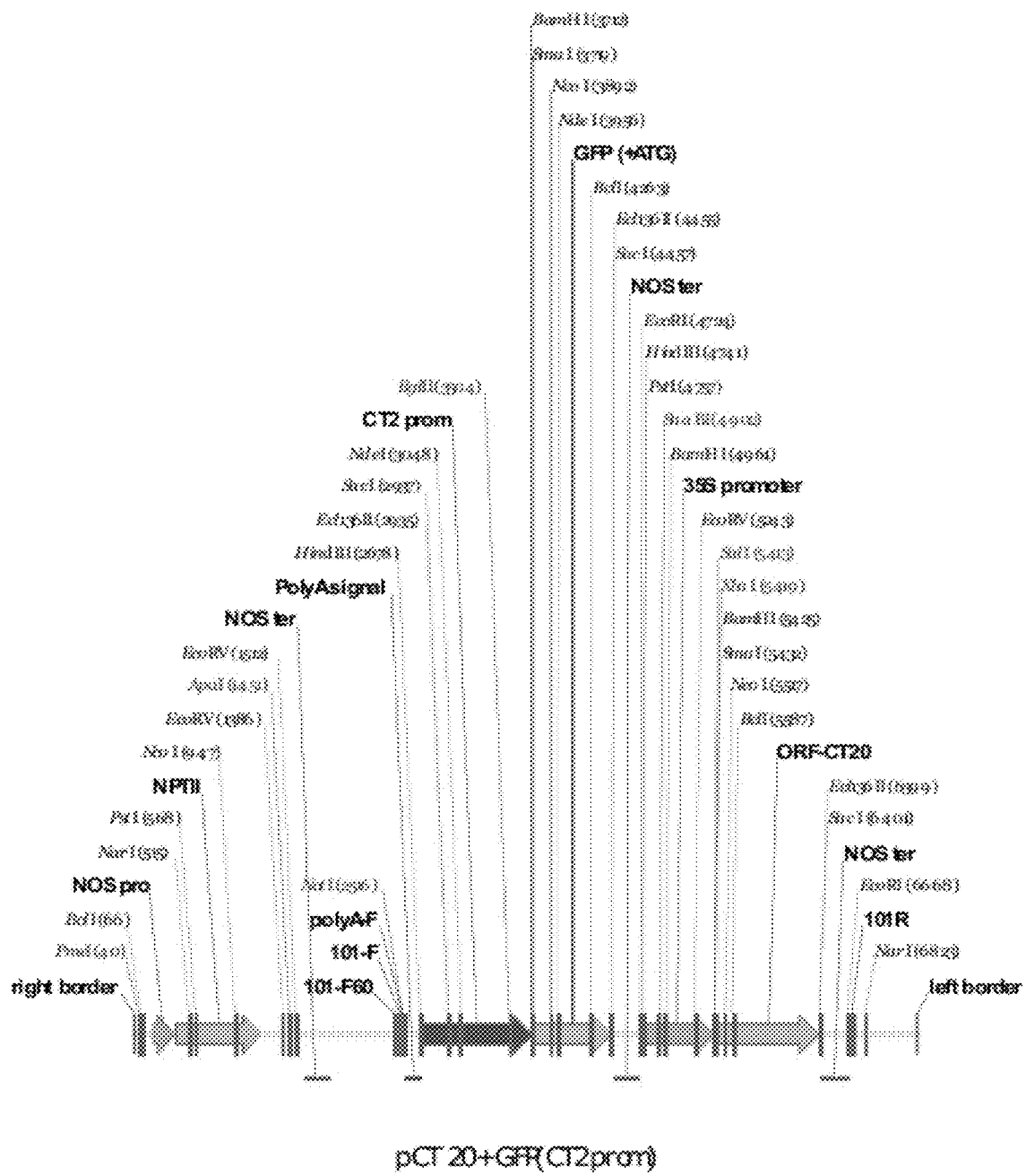

FIGS. 2*a-d* are bar graph depicting the expression profile of selected fiber development genes at various developmental stages measured in days post anthesis (DPA) and tissues. FIG. 2*a*—CT4 (SEQ ID NO:842); FIG. 2*b*—CT74 (SEQ ID NO:843); FIG. 2*c*—CT11 (SEQ ID NO:844); FIG. 2*d*—CT9 (SEQ ID NO:857). The developmental stages and tissues were as follows: (a) −2 DPA; (b) 0-1 DPA; (c) 2-3 DPA; (d) 4-5 DPA; (e) 6-8 DPA; (f) 9-11 DPA; (g) 12-14 DPA; (h) 15-17 DPA; (i) 18-20 DPA; (j) young leaves: (k) young stems; (l) young roots; (m) leaves; (n) stems; (o) sepals; (p) petals; (q) stamen (*G. hirsutum* var. *Acala*) plants. Relative amounts of mRNA are presented in all examined tissues. The y-axis represents the expression level normalized against three different housekeeping genes;

FIGS. 3*a-f* are photomicrographs depicting fiber-specific promoter evaluation in *Arabidopsis*. Expression of GUS in leafs (FIGS. 3*a-c*) and roots (FIGS. 3*d-f*) under regulation of 35S promoter (SEQ ID NO:841) (FIGS. 3*a* and *d*), CT4 promoter (SEQ ID NO:848) (FIGS. 3*b* and *e*) and CT74 promoter (SEQ ID NO:851) (FIGS. 3*c* and *f*). Note the high staining intensity (corresponding to high expression level) of GUS in the leafs of *Arabidopsis* plants under the CT4 (FIG. 3*b*) or the CT74 (FIG. 3*c*) promoters;

FIGS. 4*a-c* are photomicrographs depicting promoter detection in cotton balls using a specific embodiment of the transient assay described herein, Agroinjection of GUS under regulation of CT2 or 35S promoters. FIG. 4a—CT2::GUS at 3 DPA; FIG. 4b—35S::GUS at 3DPA; FIG. 4c—35S::GUS at 8 DPA;

FIGS. 5a-c are photomicrographs depicting overexpression of CT20 and expansin in cis to GFP reporter gene by transient transfection of cotton balls at 4 DPA development fibers. For control, the agroinjection of CT2::GFP was used; FIG. 5a—CT2::GFP (control); FIG. 5b—CT2::GFP+35S::CT20 (by transient transfection of the binary vector depicted in FIG. 7); FIG. 5c—CT2::GFP+35S::Expansin;

FIG. 6 is a schematic illustration depicting an exemplary binary vector of the invention [designated pGI(CT2 promoter)+CT82(35S promoter)], in which the CT82 ORF (SEQ ID NO:890) is under the transcriptional control of the constitutive 35S promoter (SEQ ID NO:841) and the GUSIntron (SEQ ID NO:872) is under the transcriptional control of the CT2 promoter (SEQ ID NO:873). NOS pro=nopaline synthase promoter; NPT-II=neomycin phosphotransferase gene; NOS ter=nopaline synthase terminator;

FIG. 7 is a schematic illustration depicting an exemplary binary vector of the invention [designated pCT20+GFP (CT2prom)], in which the GFP open reading frame (ORF) (SEQ ID NO:871) is under the transcriptional control of the CT2 promoter (SEQ ID NO:873) and the CT20ORF (SEQ ID NO:881) is under the transcriptional control of the constitutive 35S promoter (SEQ ID NO:841). NOS pro=nopaline synthase promoter; NPT-II=neomycin phosphotransferase gene; NOS ter=nopaline synthase terminator;

DESCRIPTION OF SPECIFIC EMBODIMENTS OF THE INVENTION

The invention, in some embodiments thereof, relates to polynucleotides and polypeptides involved in plant-fiber development and methods of using same for improving fiber quality and/or yield/biomass/vigor of a plant, and in an exemplary embodiment a fiber-producing plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the invention to practice, the present inventors have identified polynucleotides and polypeptides encoded thereby which are involved in fiber development and which can be used to increase fiber quality and/or yield and plant biomass.

Thus, as described in the Examples section which follows, the present inventors have devised a novel computational approach combined with fiber related expression profile data generated using cotton oligonucleotide microarray and quantitative RT-PCR to identify genes which play a role in fiber development. Genes which are expressed during fiber initiation and elongation, in elongated tissues such as root tips, xylem and/or under etiolating conditions such as abiotic stress (e.g., drought) were identified (Example 1 of the Examples section which follows) and their expression profile was determined in a variety of cotton plants at several fiber developmental stages (Examples 2, 3 and 4 of the Example section which follows). Genes in which the expression profile correlated with fiber development were selected (polynucleotides SEQ ID NOs:1-129; polypeptides SEQ ID NOs:130-258; Table 7, Example 4 of the Examples section which follows), as well as homologous polypeptides (SEQ ID NOs: 536-791) from other plant species (Table 8, Example 4 of the Examples section which follows). As is further described in Examples 5, 6 and 7 of the Examples section which follows, exogenous expression of binary nucleic acid vectors harboring selected fiber development genes (e.g., SEQ ID NOs:1-17, 22 and 37) under the transcriptional control of a constitutive promoter (Cauliflower Mosaic Virus 35S promoter) in tomato plants resulted in an overall effect on the length of tomato seed hair. In addition, promoter sequences of genes involved in fiber development were isolated (SEQ ID NOs: 851, 848, 857, or 854; Example 8 of the Examples section which follows), cloned in binary vectors upstream of a reported gene (GUS) (Example 9 of the Examples section) and exogenously expressed in tomato plants (Example 10 of the Examples section). These expression studies demonstrated the identification of promoter sequences which are active during initiation (CT4 promoter; SEQ ID NO:848) or elongation (CT9 and CT74 promoters; SEQ ID NOs:857 and 851, respectively) of fiber development (Example 10 of the Examples section). Altogether, these results demonstrate that the isolated polynucleotides (e.g., SEQ ID NOs:1-129 and 259-535) and polypeptides (e.g., SEQ ID NOs:130-258 and 536-791) of the invention, as well as the isolated fiber development promoters (e.g., SEQ ID NOs:851, 848, 857, or 854) can be used to improve fiber quality and/or yield of a fiber producing plant and increase the biomass/vigor/yield as well as resistance or tolerance to abiotic stress of plants altogether.

Thus, according to one aspect of the invention, there is provided an isolated polynucleotide comprising a nucleic acid sequence encoding a polypeptide having an amino acid sequence at least 80% homologous to an amino acid sequence selected from the group consisting of SEQ ID NOs:130, 141, 131, 146, 139, 140, 137, 133, 136, 135, 134, 132, 138, 142, 143, 144, 145, 147-258 and 536-791, wherein the polypeptide is capable of regulating fiber development.

As used herein the phrase "fiber producing plant" refers to plants that share the common feature of having an elongated shape and abundant cellulose in thick cell walls, typically termed as secondary walls. Such walls may or may not be lignified, and the protoplast of such cells may or may be viable at maturity. Such fibers have many industrial uses, for example in lumber and manufactured wood products, paper, textiles, sacking and boxing material, cordage, brushes and brooms, filling and stuffing, caulking, reinforcement of other materials, and manufacture of cellulose derivatives.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

According to an embodiment of this aspect of the invention the fiber producing plant is cotton.

As used herein the term "cotton" refers to a wild-type, a cultivated variety (e.g., hybrid) or a transgenic cotton (Gossypium) plant.

The phrase "cotton fiber development" refers to the development of the hair of the cotton seed.

As used herein the term "development" when used in context of fibers (e.g., cotton fibers) refers to initiation of the fiber (formation of fiber) and/or elongation thereof, as well as to the fiber secondary cell wall thickening and maturation.

Thus, the invention encompasses polynucleotides identified using the present methodology and their encoded polypeptide as well as polynucleotides encoding functional equivalents of the polypeptides identified herein (i.e., polypeptides which are capable of regulating fiber development, as can be determined according to the assays described in the Examples section which follows). Such functional equivalents can be at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, e.g., 96%, 97%, 98%, 99% or 100% homologous to an amino acid sequence selected from the group consisting of SEQ ID NO:130, 141, 131, 146, 139, 140, 137, 133, 136, 135, 134, 132, 138, 142, 143, 144, 145, 147-258 and 536-791.

Homology of an amino acid sequence (e.g., percent homology) can be determined using any homology comparison software, including for example, the BlastP software of the National Center of Biotechnology Information (NCBI) such as by using default parameters.

Polynucleotides encoding the functional equivalents can be at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% identical or homologous to a nucleic acid sequence selected from the group consisting of SEQ ID NO:1, 12, 2, 17, 10, 11, 8, 4, 7, 6, 5, 3, 9, 13, 14, 15, 16, 18-129 and 259-535.

Identity of a nucleic acid sequence (e.g., percent homology) can be determined using any homology comparison software, including for example, the BlastN software of the National Center of Biotechnology Information (NCBI) such as by using default parameters.

As used herein the phrase "an isolated polynucleotide" refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the invention, as well as some intronic sequences interposing therebetween. The intronic sequences can be of any source, including of other genes, and typically will include conserved splicing signal sequences. Such intronic sequences may further include cis acting expression regulatory elements.

According to an embodiment of this aspect of the invention, the nucleic acid sequence is as set forth in SEQ ID NO:1, 12, 2, 17, 10, 11, 8, 4, 7, 6, 5, 3, 9, 13, 14, 15, 16, 18-129, 259-534 or 535.

According to an embodiment of this aspect of the invention, the isolated polynucleotide is as set forth in SEQ ID NO:1, 12, 2, 17, 10, 11, 8, 4, 7, 6, 5, 3, 9, 13, 14, 15, 16, 18-129, 259-534 or 535.

According to an embodiment of this aspect of the invention, the amino acid sequence is as set forth in SEQ ID NO:130, 141, 131, 146, 139, 140, 137, 133, 136, 135, 134, 132, 138, 142, 143, 144, 145, 147-258, 536-790 or 791.

According to an embodiment of this aspect of the invention, the polypeptide is as set forth in SEQ ID NO:130, 141, 131, 146, 139, 140, 137, 133, 136, 135, 134, 132, 138, 142, 143, 144, 145, 147-258, 536-790 or 791.

The isolated polynucleotides of this aspect of the invention can be also qualified using a hybridization assay by incubating the isolated polynucleotides described above in the presence of an oligonucleotide probe or primer under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}$P labeled probe, at 65° C., with a final wash solution of 1×SSC and 0.1% SDS and final wash at 50° C.

Nucleic acid sequences encoding the polypeptides of the invention may be optimized for plant expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization tables such as those provided on-line at the Codon Usage Database through the NIAS (National Institute of Agrobiological Sciences) DNA bank in Japan (http://www.kazusa.or.jp/codon/). The Codon Usage Database contains codon usage tables for a number of different species, with each codon usage table having been statistically determined based on the data present in Genbank.

By using the above tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

Since the polynucleotide sequences of the invention encode previously unidentified polypeptides, the invention also encompasses novel polypeptides or portions thereof, which are encoded by the isolated polynucleotides and respective, nucleic acid fragments thereof described hereinabove. The amino acid sequences of these novel polypeptides are set forth in SEQ ID NO:130, 141, 131, 146, 139, 140, 137, 133, 136, 135, 134, 132, 138, 142, 143, 144, 145, 147-258 and 536-791.

The invention also encompasses homologues of these polypeptides, such homologues can be at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, homologous to an amino acid sequence selected from the group consisting of SEQ ID NOs:130, 141, 131, 146, 139, 140, 137, 133, 136, 135, 134, 132, 138, 142, 143, 144, 145, 147-258 and 536-791.

According to an embodiment of the invention, the isolated polypeptide of the invention is selected from the group consisting of SEQ ID NOs:130, 141, 131, 146, 139, 140, 137, 133, 136, 135, 134, 132, 138, 142, 143, 144, 145, 147-258 and 536-791.

The invention also encompasses fragments of the above described polypeptides and polypeptides having mutations, such as deletions, insertions or substitutions of one or more amino acids, either naturally occurring or man induced, either randomly or in a targeted fashion.

As mentioned above and described in Examples 8, 9 and 10 of the Examples section which follows, the present inventors have isolated promoter sequences (SEQ ID NOs:851, 848, 857, or 854) of genes involved in cotton fiber development [CT4 (SEQ ID NO:842), CT9 (SEQ ID NO:843), CT11 (SEQ ID NO:844) and CT74 (SEQ ID NO:845)] and demonstrated their ability to direct an expression of a reporter gene in a plant cell.

Thus, according to another aspect of the invention, there is provided an isolated polynucleotide comprising a nucleic acid sequence at least 90%, at least 91%, at least 92%, at least 93%, at least 94%, at least 95%, at least 96%, at least 97%, at least 98%, at least 99% identical to SEQ ID NO:851, 848, 857, or 854, wherein the nucleic acid sequence is capable of regulating an expression of a heterologous polynucleotide sequence operably linked thereto.

As used herein the phrase "heterologous polynucleotide sequence" refers to a polynucleotide from a different species or from the same species but from a different gene locus as of the isolated polynucleotide sequence (e.g., the promoter sequence).

A heterologous polynucleotide sequence is "operably linked" to a regulatory sequence (e.g., the promoter sequence set forth by SEQ ID NO:851, 848, 857, or 854) if the regulatory sequence is capable of exerting a regulatory effect on the heterologous polynucleotide sequence linked thereto. Preferably, the regulatory sequence is positioned 1-500 bp upstream of the ATG codon of the heterologous polynucleotide sequence, although it will be appreciated that regulatory sequences can also exert their effect when positioned elsewhere with respect to the coding nucleic acid sequence (e.g., within an intron).

According to an embodiment of the invention, the isolated polynucleotide sequence of this aspect of the invention (the promoter sequence) comprises less than about 1800 nucleic acids in length, e.g., less than about 1500 nucleic acids in length.

According to an embodiment of this aspect of the invention, the isolated polynucleotide sequence comprises a nucleic acid sequence as set forth by SEQ ID NO:851, 857, 848 or 854.

As mentioned hereinabove and described in FIGS. 3a-f, Table 12 and Example 10 of the Examples section which follows, the isolated promoter sequences of the invention were capable of directing an expression of a reporter gene (GUS) during fiber development.

According to an embodiment of the invention, the isolated polynucleotide sequence (the promoter sequence) of the invention is capable of regulating expression of the heterologous polynucleotide sequence in an ovule epidermal cell.

According to an embodiment of the invention, the ovule epidermal cell comprises a plant fiber or a trichome.

The ability of polynucleotides of the invention and their products to regulate cotton fiber development can be determined directly on at least one structural parameter of a cotton fiber such as fiber length or fiber finesse, or fiber growth rate (further described hereinbelow). Alternatively, cotton fiber development can be determined indirectly by using plant model systems for cotton fiber development such as trichome cells and root hairs [see Examples 7, 10 and 11 of the Examples section which follows and Wagner. G. J. et. al. (2004)].

By analyzing expression profiles of the isolated polynucleotides of the invention and correlating between gene expression profile and fiber length (see Example 3 and 4 of the Examples section), the present inventors were able to determine the involvement of the biomolecule sequences (i.e., polynucleotides and polypeptides) of the invention in fiber initiation and/or elongation and plant biomass.

Thus, according to yet another aspect of the invention there is provided a method of improving fiber quality and/or yield of a fiber producing plant. The method of this aspect of the invention is effected by exogenously expressing at least a functional portion of the isolated polypeptide of the invention in the fiber producing plant, thereby improving the quality and/or yield of the fiber producing plant.

As used herein the phrase "fiber quality" refers to at least one fiber parameter which is agriculturally desired, or required in the fiber industry (further described herein below). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "improving" refers to at least about 5%, at least about 10%, at least about 15%, at least about 20%, at least about 30%, at least about 40%, at least about 50%, at least about 60%, at least about 70%, at least about 80%, change in fiber quality/yield as compared to a native plant (i.e., not modified with the biomolecule sequences of the invention).

As used herein the phrase "exogenously expressing" refers to an expression of at least a functional portion of the isolated polypeptide of the invention from an exogenous polynucleotide sequence (i.e., a polynucleotide sequence not derived from the host cell) introduced to the host cell (a plant cell in this case).

The exogenous polynucleotide sequence of the invention is designed and constructed to express at least a functional portion of the isolated polypeptide of the invention (e.g., the portion capable of improving fiber yield/quality, increasing biomass). Accordingly, the exogenous polynucleotide sequence may be a DNA or RNA sequence encoding a polypeptide molecule, capable of improving fiber yield or quantity. Alternatively, the exogenous polynucleotide may be a cis-acting regulatory region (e.g., SEQ ID NO:851, 848, or 857) which may be introduced into the plant to increase expression of any polynucleotide which is involved in fiber development (e.g., sucrose phosphate synthase, as described in U.S. Pat. No. 6,472,588; or any of the isolated polynucleotide sequences set forth by SEQ ID NOs:1, 12, 2, 17, 10, 11, 8, 4, 7, 6, 5, 3, 9, 13, 14, 15, 16, 18-129, 259-534 or 535).

To express exogenous polynucleotides in plant cells, a polynucleotide sequence of the invention can be ligated into a nucleic acid construct suitable for plant cell expression. Such a nucleic acid construct includes at least one cis-acting regulatory element operably linked to the isolated polynucleotide such as a promoter sequence for directing transcription of the polynucleotide sequence in the cell in a constitutive or inducible manner. The promoter may be homologous or heterologous to the transformed plant/cell.

Promoter sequences which can be used in accordance with this aspect of the invention are epidermal cell promoters.

For example, promoter sequences of each of the polynucleotide sequences of the invention may be used in the nucleic acid constructs of the invention.

According to an embodiment of this aspect of the invention the promoter is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to SEQ ID NO:851, 848, 857, or 854, which is capable of regulating expression of at least one polynucleotide sequence operably linked thereto in an ovule epidermal cell.

Other examples of cotton fiber-enhanced promoters include those of the cotton fiber-expressed genes E6 (John et al., Plant Mol. Biol., 30:297-306 (1996) and John et al., Proc. Natl. Acad. Sci., 93:12768-12773, 1996), H6 (John et al., Plant Physiol., 108:669-676, 1995), FbL2A (Rinehart et al., Plant Physiol., 112:1331-1341, 1996) and John et al, Proc. Natl. Acad. Sci. USA, 93:12768-12773, 1996), rac (Delmer et al., Mol. Gen. Genet., 248:43-51, 1995); CelA (Pear et al., Proc. Natl. Acad. Sci. USA, 93:12637-12642, 1996); CAP (Kawai et al., Plant Cell Physiol. 39:1380-1383, 1998); ACP (Song et al., Biochim. Biophys. Acta 1351:305-312, 1997); and LTP (Ma et al., Biochim. Biophys. Acta 1344:111-114, 1997). Other cotton fiber specific promoters are disclosed in U.S. Pat. No. 5,495,070.

Other cotton fiber development promoters are disclosed in PCT No IL2005/000627 to the present inventors (e.g., SEQ ID NO:85 or 91 therein).

Other promoters which can be used in accordance with this aspect of the invention are those that ensure expression only in specified organs, such as the leaf, root, tuber, seed, stem, flower or specified cell types such as parenchyma, epidermal, trichome or vascular cells.

Promoters for enhancing expression in trichome cells are disclosed in WO2004/111183, to Evogene Ltd.

Promoters enhancing expression in vascular tissue include the CAD 2 promoter (Samaj et al., Planta, 204:437-443, 1998), the Pt4C11 promoter (Hu et al., Proc. Natl. Acad. Sci. USA, 95:5407-5412, 1998), the C4H promoter (Meyer et al., Proc. Natl. Acad. Sci. USA, 95:6619-6623, 1998), the PtX3H6 and PtX14A9 promoters (Loopstra et al., Plant Mol. Biol., 27:277-291, 1995), the RolC promoter (Graham, Plant Mol. Biol., 33:729-735, 1997), the Hvhsp17 promoter (Raho et al., J. Expt. Bot., 47:1587-1594, 1996), and the COMT promoter (Capellades et al., Plant Mol. Biol., 31:307-322, 1996).

Promoters enhancing expression in stem tissue include pith promoters (Datta, Theor. Appl. Genet., 97:20-30, 1998) and Ohta et al., Mol. Gen. Genet., 225:369-378, 1991), and the anionic peroxidase promoter (Klotz et al., Plant Mol. Biol., 36:509-520, 1998). Preferred promoters enhancing expression in phloem, cortex and cork, but not xylem or pith, include the Psam-1 promoter (Mijnsbrugge et al., Plant and Cell Physiol., 37:1108-1115, 1996).

Promoters enhancing expression in seeds include the phas promoter (Geest et al., Plant Mol. Biol. 32:579-588, 1996);

the GluB-1 promoter (Takaiwa et al., Plant Mol. Biol. 30:1207-1221, 1996); the gamma-zein promoter (Torrent et al. Plant Mol. Biol. 34:139-149, 1997), and the oleosin promoter (Sarmiento et al., The Plant Journal 11:783-796, 1997).

Other promoter sequences which mediate constitutive, inducible, tissue-specific or developmental stage-specific expression are disclosed in WO2004/081173 to Evogene Ltd.

Truncated or synthetic promoters including specific nucleotide regions conferring tissue-enhanced expression may also be used, as exemplified by identification of regulatory elements within larger promoters conferring xylem-enhanced expression (Seguin et al., Plant Mol. Biol., 35:281-291, 1997; Torres-Schumann et al., The Plant Journal, 9:283-296, 1996; and Leyva et al., The Plant Cell, 4:263-271, 1992).

The nucleic acid construct can be, for example, a plasmid, a bacmid, a phagemid, a cosmid, a phage, a virus or an artificial chromosome. Preferably, the nucleic acid construct of the invention is a plasmid vector, more preferably a binary vector.

The phrase "binary vector" refers to an expression vector which carries a modified T-region from Ti plasmid, enable to be multiplied both in E. coli and in Agrobacterium cells, and usually comprising reporter gene(s) for plant transformation between the two boarder regions. A binary vector suitable for the invention includes pBI2113, pBI121, pGA482, pGAH, pBIG, pBI101 (Clonetech), pPI (see Examples 5 and 10 of the Examples section which follows) or modifications thereof.

The nucleic acid construct of the invention can be utilized to transform a host cell (e.g., bacterial, plant) or plant.

As used herein, the terms "transgenic" or "transformed" are used interchangeably referring to a cell or a plant into which cloned genetic material has been transferred.

In stable transformation, the nucleic acid molecule of the invention is integrated into the plant genome, and as such it represents a stable and inherited trait. In transient transformation, the nucleic acid molecule is expressed by the cell transformed but not integrated into the genome, and as such represents a transient trait.

There are various methods of introducing foreign genes into both monocotyledonous and dicotyledonous plants (Potrykus, I. (1991). Annu Rev Plant Physiol Plant Mol Biol 42, 205-225; Shimamoto, K. et al. (1989). Fertile transgenic rice plants regenerated from transformed protoplasts. Nature (1989) 338, 274-276).

The principal methods of the stable integration of exogenous DNA into plant genomic DNA includes two main approaches:

(i) Agrobacterium-mediated gene transfer. See: Klee, H. J. et al. (1987). Annu Rev Plant Physiol 38, 467-486; Klee, H. J. and Rogers, S. G. (1989). Cell Culture and Somatic Cell Genetics of Plants, Vol. 6, Molecular Biology of Plant Nuclear Genes, pp. 2-25, J. Schell and L. K. Vasil, eds., Academic Publishers, San Diego, Calif.; and Gatenby, A. A. (1989). Regulation and Expression of Plant Genes in Microorganisms, pp. 93-112, Plant Biotechnology, S. Kung and C. J. Arntzen, eds., Butterworth Publishers, Boston, Mass.

(ii) Direct DNA uptake. See, e.g.: Paszkowski, J. et al. (1989). Cell Culture and Somatic Cell Genetics of Plants, Vol. 6, Molecular Biology of Plant Nuclear Genes, pp. 52-68, J. Schell and L. K. Vasil, eds., Academic Publishers, San Diego, Cal.; and Toriyama, K. et al. (1988). Bio/Technol 6, 1072-1074 (methods for direct uptake of DNA into protoplasts). See also: Zhang et al. (1988). Plant Cell Rep 7, 379-384; and Fromm, M. E. et al. (1986). Stable transformation of maize after gene transfer by electroporation. Nature 319, 791-793 (DNA uptake induced by brief electric shock of plant cells). See also: Klein et al. (1988). Bio/Technology 6, 559-563; McCabe, D. E. et al. (1988). Stable transformation of soybean (Glycine max) by particle acceleration. Bio/Technology 6, 923-926; and Sanford, J. C. (1990). Biolistic plant transformation. Physiol Plant 79, 206-209 (DNA injection into plant cells or tissues by particle bombardment). See also: Neuhaus, J. M. et al. (1987). Theor Appl Genet. 75, 30-36; and Neuhaus, J. M. and Spangenberg, G. C. (1990). Physiol Plant 79, 213-217 (use of micropipette systems). See U.S. Pat. No. 5,464,765 (glass fibers or silicon carbide whisker transformation of cell cultures, embryos or callus tissue). See also: DeWet, J. M. J. et al. (1985). "Exogenous gene transfer in maize (Zea mays) using DNA-treated pollen," Experimental Manipulation of Ovule Tissue, G. P. Chapman et al., eds., Longman, New York-London, pp. 197-209; and Ohta, Y. (1986). High-Efficiency Genetic Transformation of Maize by a Mixture of Pollen and Exogenous DNA. Proc Natl Acad Sci USA 83, 715-719 (direct incubation of DNA with germinating pollen).

The Agrobacterium-mediated system includes the use of plasmid vectors that contain defined DNA segments which integrate into the plant genomic DNA. Methods of inoculation of the plant tissue vary depending upon the plant species and the Agrobacterium delivery system. A widely used approach is the leaf-disc procedure, which can be performed with any tissue explant that provides a good source for initiation of whole-plant differentiation (Horsch, R. B. et al. (1988). "Leaf disc transformation." Plant Molecular Biology Manual A5, 1-9, Kluwer Academic Publishers, Dordrecht). A supplementary approach employs the Agrobacterium delivery system in combination with vacuum infiltration. The Agrobacterium system is especially useful for in the creation of transgenic dicotyledenous plants.

There are various methods of direct DNA transfer into plant cells. In electroporation, the protoplasts are briefly exposed to a strong electric field, opening up mini-pores to allow DNA to enter. In microinjection, the DNA is mechanically injected directly into the cells using micropipettes. In microparticle bombardment, the DNA is adsorbed on microprojectiles such as magnesium sulfate crystals or tungsten particles, and the microprojectiles are physically accelerated into cells or plant tissues.

Following stable transformation, plant propagation occurs. The most common method of plant propagation is by seed. The disadvantage of regeneration by seed propagation, however, is the lack of uniformity in the crop due to heterozygosity, since seeds are produced by plants according to the genetic variances governed by Mendelian rules. In other words, each seed is genetically different and each will grow with its own specific traits. Therefore, it is preferred that the regeneration be effected such that the regenerated plant has identical traits and characteristics to those of the parent transgenic plant. The preferred method of regenerating a transformed plant is by micropropagation, which provides a rapid, consistent reproduction of the transformed plants.

Micropropagation is a process of growing second-generation plants from a single tissue sample excised from a selected parent plant or cultivar. This process permits the mass reproduction of plants having the preferred tissue and expressing a fusion protein. The newly generated plants are genetically identical to, and have all of the characteristics of, the original plant. Micropropagation allows for mass production of quality plant material in a short period of time and offers a rapid multiplication of selected cultivars with preservation of the characteristics of the original transgenic or transformed plant. The advantages of this method of plant cloning include the speed of plant multiplication and the quality and uniformity of the plants produced.

Micropropagation is a multi-stage procedure that requires alteration of culture medium or growth conditions between stages. The micropropagation process involves four basic stages: stage one, initial tissue culturing; stage two, tissue culture multiplication; stage three, differentiation and plant formation; and stage four, greenhouse culturing and hardening. During stage one, the tissue culture is established and certified contaminant-free. During stage two, the initial tissue culture is multiplied until a sufficient number of tissue samples are produced to meet production goals. During stage three, the newly grown tissue samples are divided and grown into individual plantlets. At stage four, the transformed plantlets are transferred to a greenhouse for hardening where the plants' tolerance to light is gradually increased so that they can continue to grow in the natural environment.

Although stable transformation is presently preferred, transient transformation of, for instance, leaf cells, meristematic cells, or the whole plant is also envisaged by the invention.

Transient transformation can be effected by any of the direct DNA transfer methods described above or by viral infection using modified plant viruses.

Viruses that have been shown to be useful for the transformation of plant hosts include cauliflower mosaic virus (CaMV), tobacco mosaic virus (TMV), and baculovirus (BV). Transformation of plants using plant viruses is described in, for example: U.S. Pat. No. 4,855,237 (bean golden mosaic virus, BGMV); EPA 67,553 (TMV); Japanese Published Application No. 63-14693 (TMV); EPA 194,809 (BV); EPA 278,667 (BV); and Gluzman, Y. et al. (1988). Communications in Molecular Biology: Viral Vectors, Cold Spring Harbor Laboratory, New York, pp. 172-189. The use of pseudovirus particles in expressing foreign DNA in many hosts, including plants, is described in WO 87/06261.

Construction of plant RNA viruses for the introduction and expression of non-viral exogenous nucleic acid sequences in plants is demonstrated by the above references as well as by: Dawson, W. O. et al. (1989). A tobacco mosaic virus-hybrid expresses and loses an added gene. Virology 172, 285-292; French, R. et al. (1986) Science 231, 1294-1297; and Takamatsu, N. et al. (1990). Production of enkephalin in tobacco protoplasts using tobacco mosaic virus RNA vector. FEBS Lett 269, 73-76.

If the transforming virus is a DNA virus, one skilled in the art may make suitable modifications to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of the DNA will produce the coat protein, which will encapsidate the viral DNA. If the virus is an RNA virus, the virus is generally cloned as a cDNA and inserted into a plasmid. The plasmid is then used to make all of the plant genetic constructs. The RNA virus is then transcribed from the viral sequence of the plasmid, followed by translation of the viral genes to produce the coat proteins which encapsidate the viral RNA.

Construction of plant RNA viruses for the introduction and expression in plants of non-viral exogenous nucleic acid sequences, such as those included in the construct of the invention, is demonstrated in the above references as well as in U.S. Pat. No. 5,316,931.

In an embodiment, there is provided for insertion a plant viral nucleic acid, comprising a deletion of the native coat protein coding sequence from the viral nucleic acid, a non-native (foreign) plant viral coat protein coding sequence, and a non-native promoter, preferably the subgenomic promoter of the non-native coat protein coding sequence, and capable of expression in the plant host, packaging of the recombinant plant viral nucleic acid, and ensuring a systemic infection of the host by the recombinant plant viral nucleic acid. Alternatively, the native coat protein coding sequence may be made non-transcribable by insertion of the non-native nucleic acid sequence within it, such that a non-native protein is produced. The recombinant plant viral nucleic acid construct may contain one or more additional non-native subgenomic promoters. Each non-native subgenomic promoter is capable of transcribing or expressing adjacent genes or nucleic acid sequences in the plant host and incapable of recombination with each other and with native subgenomic promoters. In addition, the recombinant plant viral nucleic acid construct may contain one or more cis-acting regulatory elements, such as enhancers, which bind a trans-acting regulator and regulate the transcription of a coding sequence located downstream thereto. Non-native nucleic acid sequences may be inserted adjacent to the native plant viral subgenomic promoter or the native and non-native plant viral subgenomic promoters if more than one nucleic acid sequence is included. The non-native nucleic acid sequences are transcribed or expressed in the host plant under control of the subgenomic promoter(s) to produce the desired products.

In an embodiment of the invention, a recombinant plant viral nucleic acid construct is provided as in the first embodiment except that the native coat protein coding sequence is placed adjacent to one of the non-native coat protein subgenomic promoters instead of adjacent to a non-native coat protein coding sequence.

In an embodiment of the invention, a recombinant plant viral nucleic acid construct is provided comprising a native coat protein gene placed adjacent to its subgenomic promoter and one or more non-native subgenomic promoters inserted into the viral nucleic acid construct. The inserted non-native subgenomic promoters are capable of transcribing or expressing adjacent genes in a plant host and are incapable of recombination with each other and with native subgenomic promoters. Non-native nucleic acid sequences may be inserted adjacent to the non-native subgenomic plant viral promoters such that the sequences are transcribed or expressed in the host plant under control of the subgenomic promoters to produce the desired product.

In an embodiment of the invention, a recombinant plant viral nucleic acid construct is provided as in the third embodiment except that the native coat protein coding sequence is replaced by a non-native coat protein coding sequence.

Viral vectors are encapsidated by expressed coat proteins encoded by recombinant plant viral nucleic acid constructs as described hereinabove, to produce a recombinant plant virus. The recombinant plant viral nucleic acid construct or recombinant plant virus is used to infect appropriate host plants. The recombinant plant viral nucleic acid construct is capable of replication in a host, systemic spread within the host, and transcription or expression of one or more foreign genes (isolated nucleic acid) in the host to produce the desired protein.

In addition to the above, the nucleic acid molecule of the invention can also be introduced into a chloroplast genome thereby enabling chloroplast expression.

A technique for introducing exogenous nucleic acid sequences to the genome of the chloroplasts is known. This technique involves the following procedures. First, plant cells are chemically treated so as to reduce the number of chloroplasts per cell to about one. Then, the exogenous nucleic acid is introduced into the cells preferably via particle bombardment, with the aim of introducing at least one exogenous nucleic acid molecule into the chloroplasts. The exogenous nucleic acid is selected by one ordinarily skilled in the art to be capable of integration into the chloroplast's genome via homologous recombination, which is readily effected by enzymes inherent to the chloroplast. To this end, the exogenous nucleic acid comprises, in addition to a gene of interest, at least one nucleic acid sequence derived from the chloroplast's genome. In addition, the exogenous nucleic acid comprises a selectable marker, which by sequential selection procedures serves to allow an artisan to ascertain that all or substantially all copies of the chloroplast genome following such selection include the exogenous nucleic acid. Further details relating to this technique are found in U.S. Pat. Nos. 4,945,050 and 5,693,507, which are incorporated herein by reference. A polypeptide can thus be produced by the protein expression system of the chloroplast and become integrated into the chloroplast's inner membrane.

It will be appreciated that the generation of fiber producing plant of desired traits according to the invention can also be effected by crossing each of the above genetically modified plants with wild type, hybrid or transgenic plants, using methods which are well known in the art.

Once the transgenic plants of the invention are generated, fibers are harvested (for example by mechanical picking and/or hand-stripping) and fiber yield and quality is determined.

The following describes methods of qualifying cotton fibers.

Fiber length—Instruments such as a fibrograph and HVI (high volume instrumentation) systems are used to measure the length of the fiber. HVI instruments compute length in terms of "mean" and "upper half mean" (UHM) length. The mean is the average length of all the fibers while UHM is the average length of the longer half of the fiber distribution.

Fiber strength—As mentioned, fiber strength is usually defined as the force required to break a bundle of fibers or a single fiber. In HVI testing the breaking force is converted to "grams force per tex unit." This is the force required to break a bundle of fibers that is one tex unit in size. In HVI testing the strength is given in grams per tex units (grams/tex). Fibers can be classified as low strength (e.g., 19-22 gms/tex), average strength (e.g., 23-25 gms/tex), high strength (e.g., 26-28 gms/tex), and very high strength (e.g., 29-36 gms/tex).

Fiber fineness a and fiber weight per unit length—increased fiber fineness is likely attributable to increased fiber wall thickness yielding more weight per unit length.

Maturity ratio—is a measure of the relative amount of cellulose in the fiber cross-section.

Uniformity—The degree to which the fibers in a sample are uniform is based on the ratio of mean length to the upper half mean length, given as a percentage.

Micronaire—The micronaire reading of a fiber is obtained from a porous air flow test. The test is conducted as follows. A weighed sample of cotton is compressed to a given volume and controlled air flow is passed through the sample. The resistance to the air flow is read as micronaire units. The micronaire readings reflect a combination of maturity and fineness. Since the fiber diameter of fibers within a given variety of cotton is fairly consistent, the micronaire index will more likely indicate maturity variation rather than variations in fineness. A micronaire reading of 2.6-2.9 is low while 3.0-3.4 is below average, 3.5-4.9 is average and 5.0 and up are high. For most textile applications a micronaire of 3.5-4.9 is used. Anything higher than this is usually not desirable. It will be appreciated though, that different applications require different fiber properties. Thus, it is understood that a fiber property that is disadvantageous in one application might be advantageous in another.

As is illustrated in the Examples section, which follows, biomolecule sequences of the invention are capable of increasing trichome/leaf hair number and length, as well as seed hair. As such biomolecules of the invention can be used to generate transgenic plants with increased trichome number/length which better deter herbivores, guide the path of pollinators, or affect photosynthesis, leaf temperature, or water loss through increased light reflectance. Additionally such transgenic plants may be used for the compartmentalized production of recombinant proteins and chemicals in trichomes, as described in details in WO2004/111183 to Evogene Ltd.

The present inventors have also found that polynucleotide and polypeptide sequences of the invention are capable of increasing a biomass of a plant. It will be appreciated that the ability of the polypeptides of the invention to increase plant yield/biomass/vigor is inherent to their ability to promote the increase in plant cell-size or volume (as described herein).

Thus, the invention also envisages a method of increasing a biomass/vigor/yield of a plant. This is effected by upregulating expression and/or activity of at least one of the polynucleotides of the invention, as described above.

As used herein the phrase "plant biomass" refers to the amount or quantity of tissue produced from the plant in a growing season, which could also determine or affect the plant yield or the yield per growing area.

As used herein the phrase "plant vigor" refers to the amount or quantity of tissue produced from the plant in a given time. Hence increase vigor could determine or affect the plant yield or the yield per growing time or growing area.

As used herein the phrase "plant yield" refers to the amount or quantity of tissue produced and harvested as the plant produced product. Hence increase yield could affect the economic benefit one can obtain from the plant in a certain growing are and/or growing time.

As used herein the term "increasing" refers to at least about 5%, at least about 10%, at least about 15%, at least about 20%, at least about 30%, at least about 40%, at least about 50%, at least about 60%, at least about 70%, at least about 80%, increase in plant yield/biomass/vigor/or tolerance to abiotic stress (further described below) as compared to a native plant (i.e., not modified with the biomolecule sequences of the invention).

As the sequences were elected by their ability to increase root tips and fibers the disclosed sequences may be used to increase tolerance or improve resistance to abiotic stress.

The phrase "abiotic stress" used herein refers to any adverse effect on metabolism, growth, reproduction and/or viability of a plant. Accordingly, abiotic stress can be induced by suboptimal environmental growth conditions such as, for example, salinity, drought, flooding, low or high temperature, heavy metal toxicity, anaerobiosis, nutrient deficiency, atmospheric pollution or UV irradiation.

The phrase "abiotic stress tolerance" as used herein refers to the ability of a plant exogenously expressing the biomolecule sequences of the invention to endure an abiotic stress without suffering a substantial alteration in metabolism, growth, productivity and/or viability as compared to a native plant (i.e., not modified with the biomolecule sequences of the invention) under the same abiotic stress conditions.

Additionally or alternatively, such parameters can be measured in plants exogenously expressing the biomolecule sequences of the invention and can be compared to the same parameters as measured in native plants (i.e., not modified with the biomolecule sequences of the invention, e.g., wild type plants) after exposing the plants to the same abiotic stress conditions.

It will be appreciated that any plant is envisaged in accordance with these embodiments of the invention. A suitable plant for use with the method of the invention can be any monocotyledonous or dicotyledonous plant including, but not limited to, maize, wheat, barely, rye, oat, rice, soybean, peanut, pea, lentil and alfalfa, cotton, rapeseed, canola, pepper, sunflower, potato, tobacco, tomato, eggplant, eucalyptus, a tree, an ornamental plant, a perennial grass and a forage crop, coniferous plants, moss, algae, as well as other plants listed in World Wide Web (dot) nationmaster(dot)com/encyclopedia/Plantae).

The invention also encompasses a method of producing cotton fibers by (a) generating a transgenic cotton plant exogenously expressing the isolated polypeptide of the invention and (b) harvesting the fibers of the transgenic cotton plant.

Thus, the invention is of high agricultural value for promoting the yield of commercially desired crops (e.g., biomass of vegetative organ such as poplar wood, or reproductive organ such as number of seeds or seed biomass).

As is further shown in FIGS. 6 and 7 and described in Example 11 of the Examples section which follows, the present inventors have constructed vectors designed to express a cotton fiber developing gene (e.g., CT20; SEQ ID NO:881) under a constitutive promoter (e.g., 35S promoter; SEQ ID NO:841) and a reporter gene (e.g., GFP; SEQ ID NO:871) under the transcriptional regulation of a cotton fiber developing promoter (e.g., CT2 promoter; SEQ ID NO: 873), such that expression of the reporter gene pinpoints on the fibers which were transformed with the construct (e.g., by observing the fibers with the appropriate light, e.g., UV light to detect the GFP staining).

Thus, according to another aspect of the invention, there is provided a nucleic acid construct comprising: (i) a first polynucleotide sequence which comprises a reporter gene operably linked to a fiber-specific promoter; and (ii) a second polynucleotide sequence which comprises a heterologous nucleic acid sequence encoding a polypeptide-of-interest operably linked to a promoter.

It will be appreciated that the first and second polynucleotide sequences can be also constructed each in a separate nucleic acid construct which together form a nucleic acid construct system.

Thus, according to yet another aspect of the invention, there is provided a nucleic acid construct system comprising: (i) a first nucleic acid construct which comprises a first polynucleotide sequence comprising a reporter gene operably linked to a fiber-specific promoter; and (ii) a second nucleic acid construct which comprises a second polynucleotide sequence comprising a heterologous nucleic acid sequence encoding a polypeptide-of-interest operably linked to a promoter.

The fiber-specific promoter can be any promoter known to regulate fiber development (e.g., enhance fiber development) or which is specifically expressed in fibers. Non-limiting examples of fiber-specific promoters include the CT2 promoter as set forth by SEQ ID NO:873; the CT4 promoter as set forth by SEQ ID NO:848; the CT74 promoter set forth by SEQ ID NO:851, or the promoters set forth by SEQ ID NO:857 or 854.

The reporter gene can be any nucleic acid coding sequence encoding a detectable polypeptide (i.e., a polypeptide which can be detected following expression in a host cell). Non-limiting examples of reporter genes include the GFP coding sequence (e.g., SEQ ID NO:871), the GUSIntron (SEQ ID NO:872) and the cDNA encoding a non-fluorescent HaloTag protein (GenBank Accession No. AY773970) which following expression in a cell is interacted with an appropriate HaloTag ligand including a reactive linker that covalently binds to the HaloTag protein and a flexible reporter group that can be a fluorophore (Lang C, et al., 2006, J. Exp. Bot. 57: 2985-92).

The polypeptide-of-interest which is expressed in the plant can be any polypeptide which is beneficial to the plant. For example, such a polypeptide can be a polypeptide which regulates fiber development such as any of the isolated polypeptides described hereinabove (SEQ ID NOs:130, 141, 131, 146, 139, 140, 137, 133, 136, 135, 134, 132, 138, 142, 143, 144, 145, 147-258 and 536-791) or in PCT IL2005/000627 to Evogene Ltd. (e.g., the polypeptide encoded by CT20 coding sequence set forth by SEQ ID NO:881).

Non-limiting examples of heterologous nucleic acid sequences encoding the polypeptide-of-interest include any of the isolated polynucleotide sequences of the invention (e.g., SEQ ID NOs:1-129, and 259-535).

According to an embodiment of the invention the heterologous nucleic acid sequence is operably linked to a constitutive promoter (e.g., the 35S promoter as set forth by SEQ ID NO:841; Actin promoter (McElroy et al, Plant Cell, 2: 163-171, 1990); CaMV 19S (Nilsson et al., Physiol. Plant 100: 456-462, 1997); GOS2 (de Pater et al, Plant J November; 2(6):837-44, 1992); Rice cyclophilin (Bucholz et al, Plant Mol. Biol. 25(5):837-43, 1994); ubiquitin (Christensen et al, Plant Mol. Biol. 18: 675-689, 1992); Maize H3 histone (Lepetit et al, Mol. Gen. Genet. 231: 276-285, 1992); Actin 2(An et al, Plant J. 10(1); 107-121, 1996).

According to an embodiment of the invention, the heterologous nucleic acid sequence is operably linked to a fiber-specific promoter (e.g., the CT2 promoter as set forth by SEQ ID NO:873 or the CT4 promoter as set forth by SEQ ID NO:848).

Non-limiting examples of suitable nucleic acid constructs are depicted in FIGS. 6 and 7.

Such nucleic acid constructs/systems can be used to transiently express a polypeptide-of-interest (e.g., the cotton fiber developing polypeptide) in a plant (e.g., a cotton plant).

While further reducing the invention to practice, the present inventors have devised a novel approach for transiently expressing a polypeptide-of-interest (e.g., a cotton fiber developing polypeptide) in cotton ovule cells by injecting a nucleic acid construct encoding the polypeptide-of-interest into a developed cotton ball.

As is shown in FIGS. 4a-c and describe in Example 11 of the Examples section which follows, cotton balls which were injected with the nucleic acid sequences at e.g., 1 and 8 DPA expressed the reporter gene (beta-glucuronidase, GUS) in the developed ball. In addition, transient expression of the binary vectors comprising fiber developing gene (e.g., expansin or CT20) resulted in a significant effect on fiber length (FIGS. 5a-c, Table 13, Example 11 of the Examples section).

Thus, according to another aspect of the invention, there is provided a method of expressing a polypeptide-of-interest in a cotton plant. The method is effected by injecting to a cotton ball of the cotton plant a nucleic acid construct which comprises a nucleic acid sequence encoding the polypeptide-of-interest, there by expressing the polypeptide-of-interest in the cotton plant.

As used herein the phrase "cotton ball" refers to the cotton fruit at various developmental stages [e.g., 0, 2, 4 and 6 days post anthesis (DPA)].

Injection of the nucleic acid construct can be injected directly to the cotton ball, using e.g., a 1-ml syringe with a 0.5-3.6-mm needle (BD Pastipak) (See Example 11 of the Examples section). Briefly, the needle is introduced to 1 to 2 mm in depth into the fruit tissue, and the infiltration solution containing the nucleic acid construct is injected into the fruit.

According to an embodiment of the invention expressing is effected at an ovule cell of the cotton plant.

As shown in Example 11 of the examples section, the nucleic acid constructs (e.g., those described in FIG. 6 or 7) were transfected into a cell (e.g., *agrobacterium* cell), and the transformed cells are further injected to the cotton ball.

Methods of transfecting nucleic acid constructs into *agrobacteria* are known in the art and further described hereinabove and in Example 11 of the Examples section which follows.

Thus, according to an embodiment of the invention, the nucleic acid construct/system of the invention is comprised in *agrobacteria*.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the invention as delineated hereinabove and as claimed in the claims section below find experimental support in the following examples.

EXAMPLES

Reference is now made to the following examples, which together with the above descriptions illustrate some embodiments of the invention in a non limiting fashion.

Reference is now made to the following examples, which together with the above descriptions illustrate the invention in a non limiting fashion.

Generally, the nomenclature used herein and the laboratory procedures utilized in the invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683, 202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Identification of Gene Clusters Involved in Plant Fiber Development

Bioinformatics Analysis

In silico identification of cotton genes involved in fiber formation—Putative cotton genes involved in fiber formation were selected from NCBI databases of cotton expressed sequence tags (ESTs) and cDNAs. The database sequences were clustered and assembled using the LEADS™ software (Compugen, Tel Aviv, Israel). Clustering resulted in more than 18,700 clusters, each representing a different gene. An expression profile summary was compiled for each cluster by pooling all keywords included in the sequence records comprising the cluster. Genes over-expressed in fiber initiation and elongation phase were isolated. The clusters were then screened to include polynucleotides originating from libraries of addition elongated tissues such as root tips, xylem and tissues exposed to etiolating conditions. Since the main force that acts in order to elongate the cell is the cell turgor, in addition to elongated tissues, the selected genes were compared to genes expressed under abiotic stresses, mainly under drought stress (details of genes clustered and analyzed are summarized in Table 1, hereinbelow). Combining the different queries, a list of 56 predicted fiber improving gene candidates was created. Those genes were further validated using RNA expression analysis (qRT-PCR).

TABLE 1

Gene Clustering Results

| | Output non-singelton contigs | | | |
|---|---|---|---|---|
| | TIGR | | LEADS | |
| Organism | Sequences | Contigs | Sequences | Contigs |
| Cotton | 92,338 | 14,325 | 198,492 | 18,543 |
| Tomato | 148,522 | 16,247 | 209,693 | 16,322 |
| Poplar | 231,072 | 24,382 | — | — |
| Arabidopsis | 327,875 | 19,863 | — | — |
| Additional species (10)* | 1,855,997 | 174,045 | 3,076,554 | 167,956 |
| Total | 2655804 | 248,862 | 427,661 | 38,850 |

Table 1: Gene clustering results.
*The addition species that were used are: maize, rice, sorghum, soybean, grape, canola, barley, strawberry, peach and melon.

Example 2

Analysis of mRNA expression profiles of genes involved in Plant Fiber Development To study the RNA expression profile of candidate genes identified as described in Example 1 above, a reverse transcription reaction followed by real time PCR (RT-qPCR) was performed on RNA extracted from cotton plants at different stages of fiber development, as follows.

Experimental Procedures

Quantitative Real time PCR analysis (qRT PCR)—To verify the levels of expression specificity and trait-association, Reverse Transcription following quantitative (Real-Time) PCR(RTqPCR) was performed. Total RNA was extracted from cotton plants at different stages of fiber development (from the day of anthesis till day 20—post anthesis). To study the specificity of expression, RNA from other tissues of the cotton plants were collected and analyzed for control expression (i.e., young leaves, young stems, mature stems, young roots, sepals, petals, and stamen). For this purpose, RNA was extracted from Cotton tissue using Hot Borate RNA Extraction protocol according to World Wide Web (dot)eeob (dot)iastate(dot)edu/faculty/WendelJ/ultramicrorna(dot) html Reverse transcription was effected using 1.5 µg total RNA, using 300 U Super Script II Reverse Transcriptase enzyme (Invitrogen), 225 ng random deoxynucleotide hexamers (Invitrogen), 500 µM dNTPs mix (Takara, Japan), 0.2 volume of ×5 reverse transcriptase (RT) buffer (Invitrogen), 0.01 M DTT, 60 U RNAsin (Promega), DEPC treated double distilled water was added up to 37.5 µl. RT reactions were incubated for 50 minutes at 42° C., followed by 70° C. for 15 minutes cDNA was diluted 1:20 in Tris EDTA, pH=8.5 µl of the diluted cDNA was used for qRT-PCR.

Quantitative RT-PCR was performed on cDNA (5 µl), using ×1 SYBR GREEN PCR master mix (Applied Biosystems), forward and reverse primers 0.3 µM each. The ABI7000 real-time PCR machine was used with the following conditions: 50° C. for 2 minutes, 95° C. for 10 minutes, 40 times of 95° C. for 15 sec and 1 minute at 60° C., followed by 95° C. for 15 seconds, 60° C. for 60 seconds, and 70 times of 60° C. for 10 seconds+0.5° C. increase in each cycle. For each gene, a standard curve was prepared from a pool of RTs from all samples, in 5 dilutions (dilutions—1:60, 1:200, 1:600, 1:2000, 1:10000). The standard curve plot [ct (cycle threshold) vs. log (concentration)] should have $R \geq 0.98$ with an efficiency in the range of 100%±5%. The levels of expression (Qty) measured in the qPCR were calculated using the efficiency (E) of the amplification reaction and the corresponding C.T. (the cycle at which the samples crossed the threshold) Qty=E–C.T. The dissociation curves obtained were inspected for the absence of unwanted additional PCR products or primer-dimers. Reactions were repeated at least twice. The calculation method is based in the fact that the efficiencies of the reactions of the GOI (gene-of-interest) and of the housekeeping genes are similar.

To normalize the expression level between the different tissues, specific primers were designed for specifically hybridizing with the following housekeeping genes: Actin (GenBank Accession No. D88414 SEQ ID NO: 792, Forward and reverse primers are set forth in SEQ ID NOs:793 and 794, respectively), GAPDH (SEQ ID NO:795), Forward and reverse primers are set forth in SEQ ID NOs:796 and 797, respectively), and RPL19 (GenBank Accession No. A1729179, SEQ ID NO:798, Forward and reverse primers are set forth in SEQ ID NOs:799 and 800, respectively).

Experimental Results

Using the above methodology it was possible to identify genes that show elevated expression during fiber elongation, as well as genes that show unique cotton fiber specificity. Genes that showed elevated expression during anthesis that decreases during fiber elongation were considered good candidates to be involved in fiber differentiation and initiation. Notably, the above-described quantification methodology did not provide absolute expression levels, but provided good parameters for scoring the relative gene expression along fiber development as differences as high as over 1000 fold in the maximal levels of expression reached by different genes were detected (Table 2, below).

56 cotton genes were evaluated for their expression profile in different tissues of cotton (Gossypium hirsutum, var Acala).

Two main criteria were used to select cotton genes as candidates that may be involved in fiber development according to their RNA profiling, namely genes showing high degree of fiber expression specificity and genes displaying an expression level, which changes concomitantly with fiber development. Seventeen genes met these selection criteria and were predicted to improve fiber yield and quality. Expression profiles and annotation of the 17 selected genes are presented in Tables 2a and 2b and Table 3, hereinbelow.

TABLE 2a

Expression profiles of the 17 selected genes

| Gene ID/ SEQ ID NO (nucleotide). | 0 dpa | 2 dpa | 5 dpa | 10 dpa | 15 dpa | 20 dpa | 25 dpa |
|---|---|---|---|---|---|---|---|
| CTF101/3 | 0.036 | 0.133 | 0.077 | 0.071 | 0.055 | 0.039 | 0.050 |
| CTF110/4 | 0.407 | 3.192 | 1.088 | 1.630 | 0.043 | 0.006 | 0.010 |
| CTF111/5 | 0.050 | 0.899 | 0.649 | 0.901 | 0.217 | 0.013 | 0.049 |
| CTF113/6 | 0.015 | 0.012 | 0.013 | 0.009 | 0.005 | 0.001 | 0.001 |
| CTF121/18 | 0.056 | 0.020 | 0.039 | 0.021 | 0.013 | 0.001 | |
| CTF124/7 | 0.012 | 0.312 | 0.288 | 0.147 | 0.026 | 0.002 | |
| CTF126/19 | 0.008 | 0.019 | 0.012 | 0.003 | 0.009 | 0.005 | 0.002 |
| CTF130/20 | 0.000 | 0.006 | 0.003 | 0.002 | 0.001 | 0.000 | 0.000 |
| CTF131/21 | 0.009 | 0.088 | 0.050 | 0.019 | 0.011 | 0.004 | 0.012 |
| CTF132/22 | 1.300 | 5.250 | 2.882 | 1.553 | 1.164 | 1.644 | 0.567 |
| CTF133/23 | 0.131 | 0.313 | 0.214 | 0.089 | 0.150 | 0.136 | 0.111 |
| CTF134/24 | 1.221 | 0.245 | 0.232 | 0.116 | 0.153 | 0.369 | 0.227 |
| CTF135/8 | 5.869 | 18.755 | 10.243 | 4.512 | 2.033 | 1.162 | 1.934 |
| CTF144/25 | 1.851 | 0.851 | 1.676 | 1.375 | 0.220 | 0.186 | 0.010 |

TABLE 2a-continued

Expression profiles of the 17 selected genes

| Gene ID/ SEQ ID NO (nucleotide). | 0 dpa | 2 dpa | 5 dpa | 10 dpa | 15 dpa | 20 dpa | 25 dpa |
|---|---|---|---|---|---|---|---|
| CTF146/26 | 0.025 | 0.104 | 0.108 | 0.138 | 0.050 | 0.022 | 0.023 |
| CTF150/27 | 0.009 | 0.190 | 0.092 | 0.102 | 0.046 | 0.001 | 0.001 |
| CTF155/28 | 0.117 | 0.236 | 0.152 | 0.188 | 0.145 | 0.176 | 0.337 |

Table 2a: Reverse-transcription following quantitative PCR was performed using real-time PCR, on tissues of either young or mature cotton (G. hirsutum var Acala) plants. Relative amounts of mRNA of each gene are presented in all examined tissues. dpa—days post anthesis, of ovule and fibers tissues (until 10 dpa) or only fiber tissue (after 10 dpa).

TABLE 2b

Expression profiles of the 17 selected genes

| Gene ID/SEQ ID NO (nucleotide). | Sepals | Petals | Young roots | Young leaves | Young buds | Stamen | Pestel | 0 dpa |
|---|---|---|---|---|---|---|---|---|
| CTF101/3 | 0.018 | 0.004 | 0.044 | 0.015 | 0.014 | 0.004 | 0.013 | 0.036 |
| CTF110/4 | 0.026 | 0.028 | 0.024 | 0.736 | 0.761 | 0.020 | 0.010 | 0.407 |
| CTF111/5 | 0.015 | 0.996 | 0.002 | 0.031 | 0.024 | 0.152 | 3.288 | 0.050 |
| CTF113/6 | 0.008 | 0.002 | 0.283 | 0.002 | 0.003 | 0.084 | 0.002 | 0.015 |
| CTF121/18 | 0.023 | 0.527 | 0.029 | 0.001 | 0.005 | 0.680 | 1.079 | 0.056 |
| CTF124/7 | 0.001 | 0.001 | 0.034 | 0.004 | 0.002 | 0.000 | 0.003 | 0.012 |
| CTF126/19 | 0.016 | 0.016 | 0.005 | 0.004 | 0.002 | 0.008 | 0.017 | 0.008 |
| CTF130/20 | 0.000 | 0.000 | 0.000 | 0.000 | 0.000 | 0.000 | 0.000 | 0.000 |
| CTF131/21 | 0.008 | 0.077 | 0.001 | 0.001 | 0.006 | 0.083 | 0.043 | 0.009 |
| CTF132/22 | 0.283 | 0.152 | 0.035 | 0.496 | 1.126 | 0.059 | 0.286 | 1.300 |
| CTF133/23 | 0.176 | 0.543 | 0.072 | 0.042 | 0.035 | 1.117 | 0.370 | 0.131 |
| CTF134/24 | 0.124 | 0.349 | 0.179 | 0.053 | 0.164 | 0.289 | 1.343 | 1.221 |
| CTF135/8 | 3.968 | 2.389 | 0.076 | 1.333 | 3.098 | 3.326 | 17.426 | 5.869 |
| CTF144/25 | 0.883 | 0.556 | 1.314 | 0.229 | 0.685 | 0.759 | 2.638 | 1.851 |
| CTF146/26 | 0.023 | 0.252 | 0.029 | 0.007 | 0.016 | 0.067 | 0.091 | 0.025 |
| CTF150/27 | 0.005 | 0.010 | 0.000 | 0.000 | 0.002 | 0.079 | 0.002 | 0.009 |
| CTF155/28 | 0.272 | 0.839 | 0.126 | 0.108 | 0.151 | 7.598 | 1.447 | 0.117 |

Table 2b: Reverse-transcription following quantitative PCR was performed using real-time PCR, on tissues of either young or mature cotton (G. hirsutum var Acala) plants. Relative amounts of mRNA of each gene are presented in all examined tissues. dpa—days post anthesis, of ovule and fibers tissues (until 10 dpa) or only fiber tissue (after 10 dpa).

TABLE 3

Annotation of the 17 selected genes

| CTF# | Annotation | Pattern of expression | Fiber specificity |
|---|---|---|---|
| CTF101 | GTPase | Elongation | No |
| CTF110 | GDSL-motif lipase/hydrolase-like protein | Elongation | No |
| CTF111 | 3-ketoacyl-CoA synthase\|\|fatty acid elongase | Elongation | No |
| CTF113 | Raffinose synthase | Elongation | No |
| CTF121 | Pectin methylesterase PME1 | Elongation | No |
| CTF124 | Similar to acid phosphatase | Elongation | Fiber specific |
| CTF126 | Actin-depolymerizing factor 4 | Elongation | No |
| CTF130 | RING-H2 finger protein ATL2M | Elongation/ Initiation | Fiber specific |
| CTF131 | Putative glucosyltransferase | Elongation | No |
| CTF132 | serine protease-like protein | Elongation | No |
| CTF133 | Proteasome subunit | Elongation | No |
| CTF134 | Pectin methylesterase | Elongation/ Initiation | No |
| CTF135 | Proteasome subunit alpha type 5 | Elongation | No |
| CTF144 | Ascorbate oxidase precursor | Elongation/ Initiation | No |
| CTF146 | protein kinase TMK1 | Elongation | No |
| CTF150 | Putativepod-specific dehydrogenase SAC25 | Elongation | Fiber specific |
| CTF155 | Snakin-1 | Elongation | Fiber specific |

Table 3: Annotation of the 17 selected genes based on the NCBI data-base.

Example 3

Identifying Correlation Between Expression of Candidate Genes and Fiber Length

The correlation between fiber length and expression of the candidate genes was determined in 10 different cotton lines representing a wide variety of fiber length characteristics, as follows.

Experimental Procedures

Cotton lines—The 10 different cotton lines representing wide variety of fiber length characteristics included earlier G. hirsutum varieties (SA217SD and SA68SD), G. hirsutum varieties (Tamcot, Macnair, DP90 and ZG236) F1 hybrid of G. hirsutum and G. barbadense (Acalphi) and high quality of pima type (G. barbadense) (S7 and Pima).

RNA extraction—Fiber development stages, representing different fiber characteristic, at 5, 10 and 15 DPA were sampled and RNA was extracted as described in Example 2, hereinabove.

Fiber length assessment—Fiber length of the above lines was measured using a fibrograph. The fibrograph system was used to compute length in terms of "Upper Half Mean" length. The upper half mean (UHM) is the average length of longer half of the fiber distribution. The fibrograph measures length in span lengths at a given percentage point [World Wide Web(dot)cottoninc(dot)com/ClassificationofCotton/?Pg=4#Length].

Experimental Results

Ten different cotton lines were grown in Rehovot, Israel, and their fiber length was measured. The fibers UHM values were measured and the correlation between RNA expression level and the fiber length was calculated according to Pearson correlation [Hypertext Transfer Protocol (http)://davidmlane(dot)com/hyperstat/A34739(dot)html], wherein "R" is the correlation coefficient, and the value determines the significance of the correlation. Genes with R>0.4 and P<0.05 in at list one of the measured time points (i.e., 5, 10 or 15 dpa) have been considered as related to fiber elongation and were further selected for cloning and validation (data are summarized in Table 4, hereinbelow).

TABLE 4

Correlation between RNA expression level and the fiber length

|  | 5 dpa | | 10 dpa | | 15 dpa | |
| --- | --- | --- | --- | --- | --- | --- |
|  | R | P | R | P | R | P |
| CTF101 | 0.51 | 0.03 | | | 0.56 | 0.02 |
| CTF110 | 0.41 | 0.06 | 0.41 | 0.05 | | |
| CTF111 | | | 0.35 | 0.10 | 0.40 | 0.07 |
| CTF113 | 0.34 | 0.10 | 0.44 | 0.05 | 0.51 | 0.03 |
| CTF121 | | | 0.72 | 0.00 | 0.65 | 0.01 |
| CTF124 | | | | | 0.50 | 0.03 |
| CTF126 | | | 0.47 | 0.04 | | |
| CTF131 | | | | | 0.49 | 0.03 |
| CTF132 | 0.60 | 0.01 | | | 0.45 | 0.05 |
| CTF133 | 0.69 | 0.01 | | | | |
| CTF134 | | | 0.36 | 0.09 | | |
| CTF135 | | | | | 0.30 | 0.13 |
| CTF144 | | | | | 0.34 | 0.10 |

Table 4: The correlation between RNA expression level and the fiber length are presented for the three time points (5 dpa, 10 dpa and 15 dpa) using the Pearson correlation coefficient R and the p values.

Example 4

Production of Cotton Transcriptom and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol (http)://cottonevolution(dot)info/). This Cotton Oligonucleotide Microarray is composed of 12,006 Integrated DNA Technologies (IDT) oligonucleotides derived from an assembly of more than 180,000 *Gossypium* ESTs sequenced from 30 cDNA libraries.

In order to define correlations between the levels of RNA expression and fiber length, fibers from 8 different cotton lines were analyzed. These fibers were selected showing very good fiber quality and high lint index (Pima types, originating from other cotton species, namely *G. barbadense*), different levels of quality and lint indexes from various *G. hirsutum* lines: good quality and high lint index (Acala type), and poor quality and short lint index (Tamcot type, and old varieties). A summary of the fiber length of the different lines is provided in Table 5.

Experimental Procedures

RNA extraction—Fiber development stages, representing different fiber characteristics, at 5, 10 and 15 DPA were sampled and RNA was extracted as described in Example 2, hereinabove.

Fiber length assessment—Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot)cottoninc(dot)com/Classificationof-Cotton/?Pg=4#Length].

Experimental Results

Eight different cotton lines were grown in Rehovot, Israel, and their fiber length was measured. The fibers UHM values are summarized in Table 5 hereinbelow. The R square was calculated for each of the genes. Genes with R square values greater than 0.8 and P<0.05 in at list one time point, or the average expression at the different time points, were selected for further validation. The selected genes and their R square values are summarizing in Table 6.

TABLE 5

Summary of the fiber length of the 8 different cotton lines

|  | Length (UHM) | |
| --- | --- | --- |
| Cotton variety | Mean | STD |
| SA 217 SD | 0.89 | 0.04 |
| SA 68 SD | 1.01 | 0.03 |
| Tamcot | 1.06 | 0.01 |
| DP 90 | 1.1 | 0.08 |
| ZG 236 | 1.15 | 0.00 |
| Coker 310 | 1.21 | 0.02 |
| S7 | 1.26 | 0.02 |
| Pima | 1.36 | 0.00 |

Table 5: Presented are the means and standard deviations (STD) of 8 different cotton lines.

TABLE 6

Correlation between RNA expression level and the fiber length

| Ser. No. | CTF No./ SEQ ID NO: | 5 dpa | | | 10 dpa | | | 15 dpa | | | AVG | | |
| --- | --- | --- | --- | --- | --- | --- | --- | --- | --- | --- | --- | --- | --- |
|  |  | R | P | E | R | P | E | R | P | E | R | P | E |
| 1 | CTF157/29 | | | | 0.90 | 0.01 | 10.30 | 0.76 | 0.03 | 68.40 | | | |
| 2 | CTF158/30 | 0.79 | 0.02 | 34.20 | 0.79 | 0.03 | 66.90 | | | | 0.96 | 0.00 | 0.70 |
| 3 | CTF159/31 | 0.79 | 0.02 | 33.20 | 0.97 | 0.00 | 0.60 | | | | | | |
| 4 | CTF161/32 | 0.90 | 0.00 | 3.80 | | | | | | | | | |
| 5 | CTF162/9 | 0.71 | 0.05 | 82.10 | 0.91 | 0.00 | 8.70 | | | | | | |
| 6 | CTF163/33 | 0.82 | 0.01 | 21.70 | 0.93 | 0.00 | 4.20 | | | | 0.89 | 0.01 | 7.30 |
| 7 | CTF164/34 | 0.84 | 0.01 | 14.50 | | | | 0.80 | 0.02 | 40.90 | 0.94 | 0.00 | 1.40 |
| 8 | CTF165/1 | 0.92 | 0.00 | 2.20 | 0.93 | 0.00 | 5.20 | | | | 0.91 | 0.01 | 4.80 |
| 9 | CTF166/10 | | | | 0.86 | 0.01 | 24.00 | | | | 0.87 | 0.01 | 11.40 |
| 10 | CTF167/2 | | | | 0.90 | 0.01 | 12.90 | | | | 0.90 | 0.01 | 5.20 |

TABLE 6-continued

Correlation between RNA expression level and the fiber length

| Ser. No. | CTF No./ SEQ ID NO: | 5 dpa R | 5 dpa P | 5 dpa E | 10 dpa R | 10 dpa P | 10 dpa E | 15 dpa R | 15 dpa P | 15 dpa E | AVG R | AVG P | AVG E |
|---|---|---|---|---|---|---|---|---|---|---|---|---|---|
| 11 | CTF168/35 | 0.77 | 0.02 | 40.40 | 0.94 | 0.00 | 3.30 | | | | 0.94 | 0.00 | 1.60 |
| 12 | CTF169/11 | | | | 0.97 | 0.00 | 0.80 | | | | | | |
| 13 | CTF170/36 | 0.84 | 0.01 | 14.60 | 0.91 | 0.00 | 9.50 | | | | 0.95 | 0.00 | 1.10 |
| 14 | CTF171/37 | 0.75 | 0.03 | 53.10 | 0.96 | 0.00 | 1.50 | | | | | | |
| 15 | CTF172/12 | 0.77 | 0.02 | 41.10 | 0.81 | 0.03 | 51.70 | 0.75 | 0.03 | 78.90 | 0.80 | 0.03 | 30.40 |
| 16 | CTF173/13 | 0.93 | 0.00 | 1.10 | | | | 0.70 | 0.05 | 129.80 | 0.78 | 0.04 | 38.60 |
| 17 | CTF174/38 | | | | 0.97 | 0.00 | 0.50 | 0.73 | 0.04 | 93.50 | 0.92 | 0.00 | 3.40 |
| 18 | CTF175/14 | 0.90 | 0.00 | 3.90 | | | | | | | 0.83 | 0.02 | 20.00 |
| 19 | CTF176/15 | 0.92 | 0.00 | 2.10 | | | | | | | | | |
| 20 | CTF177/16 | | | | 0.88 | 0.01 | 18.40 | 0.89 | 0.00 | 6.60 | 0.90 | 0.01 | 5.20 |
| 21 | CTF178/17 | | | | 0.92 | 0.00 | 7.40 | 0.91 | 0.00 | 3.60 | 0.82 | 0.02 | 22.80 |
| 22 | CTF180/39 | 0.90 | 0.00 | 3.60 | | | | | | | | | |
| 23 | CTF181/40 | | | | | | | | | | | | |
| 24 | CTF182/41 | 0.83 | 0.01 | 19.20 | | | | | | | | | |
| 25 | CTF183/42 | 0.76 | 0.03 | 45.70 | 0.84 | 0.02 | 35.60 | | | | 0.85 | 0.02 | 15.80 |
| 26 | CTF184/43 | | | | 0.82 | 0.02 | 47.70 | | | | 0.78 | 0.04 | 39.30 |
| 27 | CTF185/44 | | | | 0.88 | 0.01 | 17.70 | | | | | | |
| 28 | CTF186/45 | 0.73 | 0.04 | 65.10 | | | | | | | 0.82 | 0.02 | 21.70 |
| 29 | CTF187/46 | 0.87 | 0.00 | 7.70 | | | | 0.75 | 0.03 | 76.50 | 0.75 | 0.05 | 51.00 |
| 30 | CTF188/47 | | | | 0.80 | 0.03 | 61.90 | | | | 0.82 | 0.03 | 24.60 |
| 31 | CTF189/48 | 0.84 | 0.01 | 16.00 | 0.80 | 0.03 | 64.20 | 0.73 | 0.04 | 97.90 | 0.79 | 0.03 | 32.50 |
| 32 | CTF190/49 | 0.74 | 0.04 | 60.70 | 0.89 | 0.01 | 13.90 | | | | | | |
| 33 | CTF191/50 | 0.83 | 0.01 | 19.30 | | | | 0.87 | 0.01 | 12.50 | 0.82 | 0.02 | 23.20 |
| 34 | CTF192/51 | | | | | | | | | | 0.87 | 0.01 | 10.10 |
| 35 | CTF193/52 | | | | 0.79 | 0.04 | 70.20 | 0.85 | 0.01 | 19.30 | 0.86 | 0.01 | 12.70 |
| 36 | CTF194/53 | 0.85 | 0.01 | 12.50 | | | | 0.81 | 0.02 | 36.70 | 0.88 | 0.01 | 9.50 |
| 37 | CTF195/54 | | | | 0.87 | 0.01 | 19.90 | | | | 0.86 | 0.01 | 11.70 |
| 38 | CTF196/55 | | | | | | | | | | | | |
| 39 | CTF197/56 | | | | 0.81 | 0.03 | 52.20 | 0.72 | 0.05 | 112.50 | | | |
| 40 | CTF199/57 | 0.81 | 0.02 | 25.80 | | | | | | | | | |
| 41 | CTF200/58 | | | | | | | 0.76 | 0.03 | 66.10 | | | |
| 42 | CTF201/59 | 0.75 | 0.03 | 54.90 | 0.82 | 0.02 | 46.30 | 0.73 | 0.04 | 93.70 | 0.78 | 0.04 | 38.30 |
| 43 | CTF202/60 | | | | 0.84 | 0.02 | 36.60 | | | | | | |
| 44 | CTF203/61 | 0.78 | 0.02 | 36.70 | 0.78 | 0.04 | 73.80 | | | | 0.82 | 0.02 | 23.60 |
| 45 | CTF204/62 | | | | | | | 0.86 | 0.01 | 16.30 | | | |
| 46 | CTF205/63 | | | | 0.87 | 0.01 | 21.10 | | | | | | |
| 47 | CTF206/64 | | | | 0.87 | 0.01 | 21.70 | | | | 0.87 | 0.01 | 11.10 |
| 48 | CTF207/65 | | | | 0.79 | 0.03 | 68.40 | 0.77 | 0.02 | 58.90 | 0.83 | 0.02 | 18.90 |
| 49 | CTF208/66 | 0.83 | 0.01 | 16.80 | | | | | | | | | |
| 50 | CTF209/67 | 0.78 | 0.02 | 38.50 | 0.85 | 0.02 | 30.60 | | | | 0.80 | 0.03 | 30.80 |
| 51 | CTF210/68 | | | | | | | 0.87 | 0.00 | 10.90 | | | |
| 52 | CTF211/69 | 0.72 | 0.05 | 76.80 | 0.83 | 0.02 | 43.90 | | | | 0.88 | 0.01 | 8.40 |
| 53 | CTF212/70 | 0.72 | 0.04 | 71.60 | | | | 0.74 | 0.04 | 87.50 | 0.82 | 0.02 | 23.80 |
| 54 | CTF213/71 | 0.83 | 0.01 | 18.30 | | | | 0.71 | 0.05 | 122.70 | | | |
| 55 | CTF214/72 | | | | | | | | | | | | |
| 56 | CTF215/73 | | | | 0.90 | 0.01 | 11.90 | | | | 0.80 | 0.03 | 29.40 |
| 57 | CTF216/74 | | | | 0.87 | 0.01 | 23.10 | | | | | | |
| 58 | CTF217/75 | 0.86 | 0.01 | 9.90 | | | | | | | | | |
| 59 | CTF218/76 | | | | 0.88 | 0.01 | 17.30 | | | | | | |
| 60 | CTF219/77 | | | | | | | | | | 0.83 | 0.02 | 19.50 |
| 61 | CTF220/78 | | | | | | | 0.90 | 0.00 | 6.50 | | | |
| 62 | CTF221/79 | | | | 0.83 | 0.02 | 43.20 | | | | | | |
| 63 | CTF222/80 | | | | 0.78 | 0.04 | 80.50 | 0.82 | 0.01 | 29.80 | | | |
| 64 | CTF223/81 | 0.84 | 0.01 | 14.30 | 0.85 | 0.02 | 29.60 | | | | 0.89 | 0.01 | 7.40 |
| 65 | CTF224/82 | 0.70 | 0.05 | 89.90 | 0.83 | 0.02 | 43.50 | | | | 0.77 | 0.04 | 41.20 |
| 66 | CTF225/83 | 0.87 | 0.01 | 8.70 | 0.84 | 0.02 | 36.50 | | | | | | |
| 67 | CTF226/84 | 0.73 | 0.04 | 70.00 | | | | 0.77 | 0.03 | 62.20 | 0.81 | 0.03 | 27.90 |
| 68 | CTF227/85 | | | | | | | | | | 0.80 | 0.03 | 31.40 |
| 69 | CTF229/86 | | | | 0.87 | 0.01 | 23.40 | | | | | | |
| 70 | CTF230/87 | 0.83 | 0.01 | 18.20 | | | | 0.87 | 0.01 | 12.50 | 0.84 | 0.02 | 18.30 |
| 71 | CTF231/88 | | | | | | | | | | 0.81 | 0.03 | 25.10 |
| 72 | CTF232/89 | | | | 0.82 | 0.02 | 48.10 | 0.71 | 0.05 | 114.50 | | | |
| 73 | CTF233/90 | 0.82 | 0.01 | 22.40 | | | | | | | | | |
| 74 | CTF234/91 | | | | | | | 0.78 | 0.02 | 51.70 | 0.87 | 0.01 | 9.70 |
| 75 | CTF235/92 | | | | 0.88 | 0.01 | 18.70 | | | | 0.72 | 0.07 | 64.00 |
| 76 | CTF236/93 | | | | 0.89 | 0.01 | 15.60 | | | | 0.81 | 0.03 | 27.10 |
| 77 | CTF237/94 | 0.88 | 0.00 | 6.70 | 0.78 | 0.04 | 73.20 | | | | 0.85 | 0.02 | 15.40 |
| 78 | CTF238/95 | | | | | | | | | | 0.81 | 0.03 | 27.80 |
| 79 | CTF239/96 | | | | | | | | | | 0.87 | 0.01 | 10.60 |

Table 6: The correlation between RNA expression level of 79 genes and the fiber length is presented for the average and the three time points (5 dpa, 10 dpa and 15 dpa) using the Pearson correlation coefficient (R) and the p values. The efficiency (E) of the amplification reaction is also presented.

The 79 genes provided in Table 6, hereinabove, met the selection criteria of R square values greater than 0.8 and P<0.05. (R and P were calculated according to Pearson correlation) [Hypertext Transfer Protocol (http://davidmlane (dot)com/hyperstat/A34739(dot)html).

Overall, 96 cotton genes (the 17 genes were described in Examples 2 and 3, and the 79 genes described in Example 4) were identified here as involved in cotton fiber development.

In addition, 33 genes (SEQ ID NOs:97-129) were identified from other plant species, sharing common features and sequence homology to one or more of the cotton genes. Altogether, 129 genes were identified using bioinformatics tools and expression studies in the present study as being able to positively affect cell growth and elongation, as well as cotton fiber characteristics. The identified genes are summarized in Table 7, hereinbelow.

TABLE 7

Summary of genes affecting cell growth and elongation and cotton fiber characteristics

| Ser. No. | Gene Name | Cluster Name | Organism | Polynucleotide SEQ ID NO: | Polypeptide SEQ ID NO: |
|---|---|---|---|---|---|
| 1 | CTF165 | AI054735 | cotton | 1 | 130 |
| 2 | CTF167 | AI725458 | cotton | 2 | 131 |
| 3 | CTF101 | AI729321 | cotton | 3 | 132 |
| 4 | CTF110 | AI725814 | cotton | 4 | 133 |
| 5 | CTF111 | TG__AI726275 | cotton | 5 | 134 |
| 6 | CTF113 | AI727515 | cotton | 6 | 135 |
| 7 | CTF124 | AI726129 | cotton | 7 | 136 |
| 8 | CTF135 | AI727537 | cotton | 8 | 137 |
| 9 | CTF162 | CO117674 | cotton | 9 | 138 |
| 10 | CTF166 | CO095695 | cotton | 10 | 139 |
| 11 | CTF169 | AI725762 | cotton | 11 | 140 |
| 12 | CTF172 | AW186826 | cotton | 12 | 141 |
| 13 | CTF173 | AI730906 | cotton | 13 | 142 |
| 14 | CTF175 | AW187393 | cotton | 14 | 143 |
| 15 | CTF176 | BE053309 | cotton | 15 | 144 |
| 16 | CTF177 | BF269648 | cotton | 16 | 145 |
| 17 | CTF178 | BF271992 | cotton | 17 | 146 |
| 18 | CTF121 | AI731653 | cotton | 18 | 147 |
| 19 | CTF126 | BF275672 | cotton | 19 | 148 |
| 20 | CTF130 | AI725540 | cotton | 20 | 149 |
| 21 | CTF131 | AI725631 | cotton | 21 | 150 |
| 22 | CTF132 | AI726672 | cotton | 22 | 151 |
| 23 | CTF133 | AI725569 | cotton | 23 | 152 |
| 24 | CTF134 | BQ404679 | cotton | 24 | 153 |
| 25 | CTF144 | AI726469 | cotton | 25 | 154 |
| 26 | CTF146 | AI730537 | cotton | 26 | 155 |
| 27 | CTF150 | AI725910 | cotton | 27 | 156 |
| 28 | CTF155 | CA992741 | cotton | 28 | 157 |
| 29 | CTF157 | BQ405530 | cotton | 29 | 158 |
| 30 | CTF158 | CO071210 | cotton | 30 | 159 |
| 31 | CTF159 | CO096649 | cotton | 31 | 160 |
| 32 | CTF161 | CO102097 | cotton | 32 | 161 |
| 33 | CTF163 | AW187222 | cotton | 33 | 162 |
| 34 | CTF164 | DV849461 | cotton | 34 | 163 |
| 35 | CTF168 | AI725617 | cotton | 35 | 164 |
| 36 | CTF170 | AI727242 | cotton | 36 | 165 |
| 37 | CTF171 | AI727506 | cotton | 37 | 166 |
| 38 | CTF174 | AW186645 | cotton | 38 | 167 |
| 39 | CTF180 | BG440663 | cotton | 39 | 168 |
| 40 | CTF181 | BF276183 | cotton | 40 | 169 |
| 41 | CTF182 | BQ402540 | cotton | 41 | 170 |
| 42 | CTF183 | BQ404247 | cotton | 42 | 171 |
| 43 | CTF184 | BQ408268 | cotton | 43 | 172 |
| 44 | CTF185 | BQ410590 | cotton | 44 | 173 |
| 45 | CTF186 | BQ412432 | cotton | 45 | 174 |
| 46 | CTF187 | CO080116 | cotton | 46 | 175 |
| 47 | CTF188 | CO087604 | cotton | 47 | 176 |
| 48 | CTF189 | CO087969 | cotton | 48 | 177 |
| 49 | CTF190 | CO108798 | cotton | 49 | 178 |
| 50 | CTF191 | CO109429 | cotton | 50 | 179 |
| 51 | CTF192 | CO121056 | cotton | 51 | 180 |
| 52 | CTF193 | CO493025 | cotton | 52 | 181 |
| 53 | CTF194 | DN758069 | cotton | 53 | 182 |
| 54 | CTF195 | DT459383 | cotton | 54 | 183 |
| 55 | CTF196 | DT555914 | cotton | 55 | 184 |
| 56 | CTF197 | DT564706 | cotton | 56 | 185 |
| 57 | CTF199 | AI054474 | cotton | 57 | 186 |
| 58 | CTF200 | AI054549 | cotton | 58 | 187 |
| 59 | CTF201 | AI055034 | cotton | 59 | 188 |
| 60 | CTF202 | AI725366 | cotton | 60 | 189 |
| 61 | CTF203 | AI725561 | cotton | 61 | 190 |
| 62 | CTF204 | AI725564 | cotton | 62 | 191 |
| 63 | CTF205 | AI725800 | cotton | 63 | 192 |

TABLE 7-continued

Summary of genes affecting cell growth and elongation and cotton fiber characteristics

| Ser. No. | Gene Name | Cluster Name | Organism | Polynucleotide SEQ ID NO: | Polypeptide SEQ ID NO: |
|---|---|---|---|---|---|
| 64 | CTF206 | AI725842 | cotton | 64 | 193 |
| 65 | CTF207 | AI725955 | cotton | 65 | 194 |
| 66 | CTF208 | AI726722 | cotton | 66 | 195 |
| 67 | CTF209 | AI726995 | cotton | 67 | 196 |
| 68 | CTF210 | AI727277 | cotton | 68 | 197 |
| 69 | CTF211 | DR457681 | cotton | 69 | 198 |
| 70 | CTF212 | AI727568 | cotton | 70 | 199 |
| 71 | CTF213 | AI727795 | cotton | 71 | 200 |
| 72 | CTF214 | BF_269744 | cotton | 72 | 201 |
| 73 | CTF215 | AI729467 | cotton | 73 | 202 |
| 74 | CTF216 | AI729616 | cotton | 74 | 203 |
| 75 | CTF217 | AI730004 | cotton | 75 | 204 |
| 76 | CTF218 | AI730197 | cotton | 76 | 205 |
| 77 | CTF219 | AI730262 | cotton | 77 | 206 |
| 78 | CTF220 | AI730418 | cotton | 78 | 207 |
| 79 | CTF221 | AI730490 | cotton | 79 | 208 |
| 80 | CTF222 | AI730776 | cotton | 80 | 209 |
| 81 | CTF223 | AI731861 | cotton | 81 | 210 |
| 82 | CTF224 | AW186914 | cotton | 82 | 211 |
| 83 | CTF225 | AW187127 | cotton | 83 | 212 |
| 84 | CTF226 | BE052628 | cotton | 84 | 213 |
| 85 | CTF227 | BE053126 | cotton | 85 | 214 |
| 86 | CTF229 | BF272961 | cotton | 86 | 215 |
| 87 | CTF230 | BF274664 | cotton | 87 | 216 |
| 88 | CTF231 | BF274983 | cotton | 88 | 217 |
| 89 | CTF232 | BF275498 | cotton | 89 | 218 |
| 90 | CTF233 | BF276821 | cotton | 90 | 219 |
| 91 | CTF234 | BG440416 | cotton | 91 | 220 |
| 92 | CTF235 | BG440584 | cotton | 92 | 221 |
| 93 | CTF236 | BG442540 | cotton | 93 | 222 |
| 94 | CTF237 | BG443240 | cotton | 94 | 223 |
| 95 | CTF238 | BG447110 | cotton | 95 | 224 |
| 96 | CTF239 | CO070299 | cotton | 96 | 225 |
| 97 |  | DY000718 | canola | 97 | 226 |
| 98 |  | MDL28470M000422 | castorbean | 98 | 227 |
| 99 |  | CV263160 | poplar | 99 | 228 |
| 100 |  | CA013415 | barley | 100 | 229 |
| 101 |  | CD820239 | canola | 101 | 230 |
| 102 |  | AW222076 | tomato | 102 | 231 |
| 103 |  | MDL28708M000182 | castorbean | 103 | 232 |
| 104 |  | BI129045 | poplar | 104 | 233 |
| 105 |  | AI773326 | tomato | 105 | 234 |
| 106 |  | EG658665 | castorbean | 106 | 235 |
| 107 |  | BP923230 | poplar | 107 | 236 |
| 108 |  | CN520627 | poplar | 108 | 237 |
| 109 |  | BQ468862 | barley | 109 | 238 |
| 110 |  | MDL29933M001398 | castorbean | 110 | 239 |
| 111 |  | CV228068 | poplar | 111 | 240 |
| 112 |  | CD208850 | sorghum | 112 | 241 |
| 113 |  | DY005814 | canola | 113 | 242 |
| 114 |  | MDL29637M000752 | castorbean | 114 | 243 |
| 115 |  | AI161767 | poplar | 115 | 244 |
| 116 |  | BG131373 | tomato | 116 | 245 |
| 117 |  | EG697134 | castorbean | 117 | 246 |
| 118 |  | BG125154 | tomato | 118 | 247 |
| 119 |  | MDL29806M000954 | castorbean | 119 | 248 |
| 120 |  | BI124474 | poplar | 120 | 249 |
| 121 |  | BU831288 | poplar | 121 | 250 |
| 122 |  | AW039858 | tomato | 122 | 251 |
| 123 |  | EG664483 | castorbean | 123 | 252 |
| 124 |  | BI127105 | poplar | 124 | 253 |
| 125 |  | BU893422 | poplar | 125 | 254 |
| 126 |  | CD822731 | canola | 126 | 255 |
| 127 |  | DY029904 | b_oleracea | 127 | 256 |
| 128 |  | AW441747 | tomato | 128 | 257 |
| 129 |  | MDL29706M001328 | castorbean | 129 | 258 |

Table 7: Summary of genes affecting cell growth and elongation and cotton fiber characteristics Polypeptides with significant homology to the identified cotton fiber improving genes, which are expected to serve the same function as the identified genes, have been identified from the databases using BLAST software (Table 8).

TABLE 8

Significantly homologous polypeptides to the cotton improving genes

| Nucleotide SEQ ID NO: | Cluster name | Organism | Polypeptide SEQ ID NO: | Homology to SEQ ID NO | % Identity | Algorithm |
|---|---|---|---|---|---|---|
| 259 | AU223627_T1 | apple | 536 | 148 | 86 | tblastn |
| 260 | AU223627_T2 | apple | 537 | 148 | 86 | tblastn |
| 261 | CN444690_T1 | apple | 538 | 186 | 89 | tblastn |
| 262 | CN488685_T1 | apple | 539 | 152 | 92 | tblastn |
| 263 | CN488848_T1 | apple | 540 | 148 | 86 | tblastn |
| 264 | CN579093_T1 | apple | 541 | 152 | 91 | tblastn |
| 265 | CN945045_T1 | apple | 542 | 186 | 89 | tblastn |
| 266 | CO416177_T1 | apple | 543 | 187 | 89 | tblastn |
| 267 | CV044307_T1 | apricot | 544 | 148 | 90 | tblastn |
| 268 | CV044352_T1 | apricot | 545 | 148 | 91 | tblastn |
| 269 | DR920252_T1 | aquilegia | 546 | 224 | 87 | tblastn |
| 270 | DR930905_T1 | aquilegia | 547 | 186 | 88 | tblastn |
| 271 | DR941117_T1 | aquilegia | 548 | 184 | 91 | tblastn |
| 272 | AT1G21720_T1 | arabidopsis | 549 | 152 | 90 | tblastn |
| 273 | AT1G77440_T1 | arabidopsis | 550 | 152 | 90 | tblastn |
| 274 | AT3G07410_T1 | arabidopsis | 551 | 230 | 91 | tblastn |
| 275 | AT3G46000_T1 | arabidopsis | 552 | 148 | 85 | tblastn |
| 276 | AT3G46010_T1 | arabidopsis | 553 | 148 | 86 | tblastn |
| 277 | AT3G46010_T2 | arabidopsis | 553 | 148 | 86 | tblastn |
| 278 | AT3G46010_T3 | arabidopsis | 554 | 148 | 86 | tblastn |
| 279 | AT3G46010_T4 | arabidopsis | 554 | 148 | 86 | tblastn |
| 280 | AT4G18800_T1 | arabidopsis | 555 | 186 | 88 | tblastn |
| 281 | AT5G04040_T1 | arabidopsis | 556 | 226 | 93 | tblastn |
| 282 | AT5G45750_T1 | arabidopsis | 557 | 186 | 89 | tblastn |
| 283 | AT5G59890_T1 | arabidopsis | 558 | 148 | 85 | tblastn |
| 284 | AM061591_T1 | b_oleracea | 559 | 148 | 89 | tblastn |
| 285 | DY013953_T1 | b_oleracea | 560 | 148 | 90 | tblastn |
| 286 | DY026130_T1 | b_oleracea | 561 | 148 | 85 | tblastn |
| 287 | DY026624_T1 | b_oleracea | 562 | 148 | 89 | tblastn |
| 288 | DY027267_T1 | b_oleracea | 563 | 148 | 85 | tblastn |
| 289 | DY027503_T1 | b_oleracea | 564 | 148 | 90 | tblastn |
| 290 | DY027503_T2 | b_oleracea | 564 | 148 | 90 | tblastn |
| 291 | DY027857_T1 | b_oleracea | 565 | 152 | 90 | tblastn |
| 292 | DY028163_T1 | b_oleracea | 566 | 148 | 85 | tblastn |
| 293 | BG543077_T1 | b_rapa | 567 | 148 | 85 | tblastn |
| 294 | BG543272_T1 | b_rapa | 568 | 148 | 90 | tblastn |
| 295 | BG544963_T1 | b_rapa | 569 | 148 | 90 | tblastn |
| 296 | BQ790771_T1 | b_rapa | 570 | 242 | 98 | tblastn |
| 297 | CO749582_T1 | b_rapa | 571 | 148 | 89 | tblastn |
| 298 | CX272524_T1 | b_rapa | 572 | 148 | 85 | tblastn |
| 299 | L38533_T1 | b_rapa | 573 | 230 | 94 | tblastn |
| 300 | DN239338_T1 | banana | 574 | 148 | 87 | tblastn |
| 301 | ES432595_T1 | banana | 575 | 152 | 87 | tblastn |
| 302 | AL501359_T1 | barley | 576 | 152 | 85 | tblastn |
| 303 | AL509680_T1 | barley | 577 | 152 | 85 | tblastn |
| 304 | DY324442_T1 | basilicum | 578 | 152 | 90 | tblastn |
| 305 | CD811679_T1 | canola | 579 | 148 | 90 | tblastn |
| 306 | CD812137_T1 | canola | 580 | 148 | 85 | tblastn |
| 307 | CD812887_T1 | canola | 581 | 148 | 85 | tblastn |
| 308 | CD814124_T1 | canola | 582 | 148 | 90 | tblastn |
| 309 | CD814355_T1 | canola | 583 | 148 | 85 | tblastn |
| 310 | CD818629_T1 | canola | 584 | 148 | 85 | tblastn |
| 311 | CD818688_T1 | canola | 585 | 148 | 90 | tblastn |
| 312 | CD819087_T1 | canola | 586 | 148 | 89 | tblastn |
| 313 | CD819123_T1 | canola | 587 | 152 | 90 | tblastn |
| 314 | CD821129_T1 | canola | 588 | 148 | 89 | tblastn |
| 315 | CD824095_T1 | canola | 589 | 148 | 89 | tblastn |
| 316 | CD824392_T1 | canola | 590 | 152 | 89 | tblastn |
| 317 | CD829819_T1 | canola | 591 | 148 | 85 | tblastn |
| 318 | CN727283_T1 | canola | 592 | 148 | 85 | tblastn |
| 319 | CN729295_T1 | canola | 593 | 148 | 85 | tblastn |
| 320 | CN737714_T1 | canola | 594 | 152 | 90 | tblastn |
| 321 | DY007433_T1 | canola | 595 | 186 | 86 | tblastn |
| 322 | DY011922_T1 | canola | 596 | 152 | 88 | tblastn |
| 323 | DY020991_T1 | canola | 597 | 186 | 86 | tblastn |
| 324 | EE454178_T1 | canola | 598 | 152 | 89 | tblastn |
| 325 | H07822_T1 | canola | 599 | 148 | 90 | tblastn |
| 326 | EE255551_T1 | castorbean | 600 | 148 | 94 | tblastn |
| 327 | EE258555_T1 | castorbean | 601 | 224 | 88 | tblastn |
| 328 | EE258555_T2 | castorbean | 602 | 224 | 88 | tblastn |
| 329 | EE259859_T1 | castorbean | 603 | 152 | 92 | tblastn |
| 330 | EG662102_T1 | castorbean | 604 | 186 | 95 | tblastn |
| 331 | MDL28966M000533_T1 | castorbean | 605 | 184 | 91 | tblastn |
| 332 | MDL29646M001115_T1 | castorbean | 606 | 139 | 85 | tblastn |

TABLE 8-continued

Significantly homologous polypeptides to the cotton improving genes

| Nucleotide SEQ ID NO: | Cluster name | Organism | Polypeptide SEQ ID NO: | Homology to SEQ ID NO | % Identity | Algorithm |
|---|---|---|---|---|---|---|
| 333 | T14887_T1 | castorbean | 607 | 148 | 88 | tblastn |
| 334 | EE488259_T1 | cherry | 608 | 148 | 85 | tblastn |
| 335 | BQ623399_T1 | citrus | 609 | 148 | 91 | tblastn |
| 336 | BQ624187_T1 | citrus | 610 | 152 | 92 | tblastn |
| 337 | BQ624753_T1 | citrus | 611 | 148 | 92 | tblastn |
| 338 | CB291434_T1 | citrus | 612 | 186 | 94 | tblastn |
| 339 | CF505092_T1 | citrus | 613 | 224 | 89 | tblastn |
| 340 | CF505190_T1 | citrus | 614 | 148 | 92 | tblastn |
| 341 | CF833473_T1 | citrus | 615 | 152 | 92 | tblastn |
| 342 | CF838037_T1 | citrus | 616 | 187 | 91 | tblastn |
| 343 | DY261108_T1 | citrus | 617 | 173 | 86 | tblastn |
| 344 | DV667368_T1 | coffea | 618 | 148 | 93 | tblastn |
| 345 | DV667647_T1 | coffea | 619 | 148 | 93 | tblastn |
| 346 | DV668122_T1 | coffea | 620 | 231 | 90 | tblastn |
| 347 | DV671720_T1 | coffea | 621 | 148 | 87 | tblastn |
| 348 | DV673964_T1 | coffea | 622 | 152 | 94 | tblastn |
| 349 | DV684181_T1 | coffea | 623 | 186 | 91 | tblastn |
| 350 | AI725473_T1 | cotton | 624 | 187 | 89 | tblastn |
| 351 | AI725715_T1 | cotton | 625 | 186 | 96 | tblastn |
| 352 | AI725715_T2 | cotton | 626 | 186 | 96 | tblastn |
| 353 | AI725715_T3 | cotton | 627 | 186 | 98 | tblastn |
| 354 | AI726232_T1 | cotton | 628 | 186 | 95 | tblastn |
| 355 | AI726275_T1 | cotton | 629 | 134 | 99 | tblastn |
| 356 | AI726544_T1 | cotton | 630 | 148 | 89 | tblastn |
| 357 | AI726815_T1 | cotton | 631 | 148 | 90 | tblastn |
| 358 | AI726907_T1 | cotton | 632 | 147 | 97 | tblastn |
| 359 | AI727140_T1 | cotton | 633 | 148 | 97 | tblastn |
| 360 | AI727282_T1 | cotton | 634 | 155 | 97 | tblastn |
| 361 | AI727959_T1 | cotton | 635 | 148 | 100 | tblastn |
| 362 | AI728713_T1 | cotton | 636 | 148 | 93 | tblastn |
| 363 | AI730512_T1 | cotton | 637 | 157 | 96 | tblastn |
| 364 | AI731512_T1 | cotton | 638 | 184 | 95 | tblastn |
| 365 | AI731769_T1 | cotton | 639 | 152 | 97 | tblastn |
| 366 | AI732019_T1 | cotton | 640 | 137 | 97 | tblastn |
| 367 | AW186735_T1 | cotton | 641 | 224 | 92 | tblastn |
| 368 | BE051989_T1 | cotton | 642 | 157 | 97 | tblastn |
| 369 | BE053515_T1 | cotton | 643 | 148 | 90 | tblastn |
| 370 | BG441743_T1 | cotton | 644 | 139 | 85 | tblastn |
| 371 | BG445675_T1 | cotton | 645 | 153 | 97 | tblastn |
| 372 | BQ404948_T1 | cotton | 646 | 184 | 97 | tblastn |
| 373 | CO076074_T2 | cotton | 647 | 225 | 88 | tblastn |
| 374 | CO090129_T1 | cotton | 648 | 148 | 89 | tblastn |
| 375 | CO107228_T1 | cotton | 649 | 160 | 90 | tblastn |
| 376 | CO117171_T1 | cotton | 650 | 148 | 92 | tblastn |
| 377 | DT563255_T1 | cotton | 651 | 186 | 94 | tblastn |
| 378 | DW495789_T1 | cotton | 652 | 149 | 96 | tblastn |
| 379 | CV478457_T1 | flax | 653 | 148 | 89 | tblastn |
| 380 | BM436339_T1 | grape | 654 | 148 | 95 | tblastn |
| 381 | BM436339_T2 | grape | 654 | 148 | 95 | tblastn |
| 382 | BQ794373_T1 | grape | 655 | 173 | 85 | tblastn |
| 383 | BQ796448_T1 | grape | 656 | 148 | 94 | tblastn |
| 384 | BQ796448_T2 | grape | 656 | 148 | 94 | tblastn |
| 385 | BQ796638_T1 | grape | 657 | 152 | 93 | tblastn |
| 386 | BQ797077_T1 | grape | 658 | 148 | 93 | tblastn |
| 387 | BQ797077_T2 | grape | 658 | 148 | 93 | tblastn |
| 388 | BQ797077_T3 | grape | 658 | 148 | 93 | tblastn |
| 389 | BQ797077_T4 | grape | 658 | 148 | 93 | tblastn |
| 390 | CB035843_T1 | grape | 659 | 224 | 88 | tblastn |
| 391 | CB911305_T1 | grape | 660 | 186 | 93 | tblastn |
| 392 | CB916297_T1 | grape | 661 | 184 | 91 | tblastn |
| 393 | CF373264_T1 | grape | 662 | 186 | 86 | tblastn |
| 394 | CN545526_T1 | grape | 663 | 139 | 85 | tblastn |
| 395 | EE106378_T1 | grape | 664 | 132 | 86 | tblastn |
| 396 | BJ554624_T1 | ipomoea | 665 | 148 | 92 | tblastn |
| 397 | BJ555556_T1 | ipomoea | 666 | 139 | 86 | tblastn |
| 398 | BJ556366_T1 | ipomoea | 667 | 152 | 92 | tblastn |
| 399 | BJ556502_T1 | ipomoea | 668 | 186 | 88 | tblastn |
| 400 | BJ559892_T1 | ipomoea | 669 | 148 | 94 | tblastn |
| 401 | BJ563588_T1 | ipomoea | 670 | 224 | 88 | tblastn |
| 402 | CB330087_T1 | ipomoea | 671 | 173 | 85 | tblastn |
| 403 | CJ738141_T1 | ipomoea | 672 | 231 | 91 | tblastn |
| 404 | EE875053_T1 | ipomoea | 673 | 148 | 94 | tblastn |
| 405 | DW043786_T1 | lettuce | 674 | 148 | 87 | tblastn |
| 406 | DW049988_T1 | lettuce | 675 | 224 | 86 | tblastn |

TABLE 8-continued

Significantly homologous polypeptides to the cotton improving genes

| Nucleotide SEQ ID NO: | Cluster name | Organism | Polypeptide SEQ ID NO: | Homology to SEQ ID NO | % Identity | Algorithm |
|---|---|---|---|---|---|---|
| 407 | DW052597_T1 | lettuce | 676 | 148 | 87 | tblastn |
| 408 | DW052758_T1 | lettuce | 677 | 152 | 90 | tblastn |
| 409 | DW053430_T1 | lettuce | 678 | 152 | 92 | tblastn |
| 410 | DW053430_T2 | lettuce | 678 | 152 | 92 | tblastn |
| 411 | DW074782_T1 | lettuce | 679 | 148 | 86 | tblastn |
| 412 | DW081477_T1 | lettuce | 680 | 152 | 91 | tblastn |
| 413 | DW081477_T2 | lettuce | 680 | 152 | 91 | tblastn |
| 414 | DW084530_T1 | lettuce | 681 | 148 | 86 | tblastn |
| 415 | DW135542_T1 | lettuce | 682 | 152 | 92 | tblastn |
| 416 | BG662283_T1 | lotus | 683 | 152 | 92 | tblastn |
| 417 | BI417319_T1 | lotus | 684 | 152 | 93 | tblastn |
| 418 | AI586912_T1 | maize | 685 | 152 | 85 | tblastn |
| 419 | AI714711_T1 | maize | 686 | 152 | 87 | tblastn |
| 420 | AI920333_T1 | maize | 687 | 184 | 91 | tblastn |
| 421 | AW054435_T1 | maize | 688 | 152 | 85 | tblastn |
| 422 | AW056991_T1 | maize | 689 | 152 | 85 | tblastn |
| 423 | BM500177_T1 | maize | 690 | 186 | 86 | tblastn |
| 424 | CD945757_T1 | maize | 691 | 186 | 86 | tblastn |
| 425 | DQ245781_T1 | maize | 692 | 148 | 85 | tblastn |
| 426 | DQ245820_T1 | maize | 693 | 148 | 85 | tblastn |
| 427 | AA661031_T1 | *medicago* | 694 | 186 | 85 | tblastn |
| 428 | AL370167_T1 | *medicago* | 695 | 152 | 89 | tblastn |
| 429 | AW686071_T1 | *medicago* | 696 | 148 | 86 | tblastn |
| 430 | AW687059_T1 | *medicago* | 697 | 152 | 92 | tblastn |
| 431 | BE205479_T1 | *medicago* | 698 | 132 | 86 | tblastn |
| 432 | AJ827186_T1 | peach | 699 | 148 | 90 | tblastn |
| 433 | AJ827260_T1 | peach | 700 | 148 | 91 | tblastn |
| 434 | AJ872529_T1 | peach | 701 | 152 | 92 | tblastn |
| 435 | BU039190_T1 | peach | 702 | 148 | 85 | tblastn |
| 436 | CD037927_T1 | peanut | 703 | 148 | 94 | tblastn |
| 437 | CX018158_T1 | peanut | 704 | 152 | 95 | tblastn |
| 438 | BM064776_T1 | pepper | 705 | 152 | 90 | tblastn |
| 439 | CA523467_T1 | pepper | 706 | 148 | 91 | tblastn |
| 440 | AF183903_T1 | *petunia* | 707 | 148 | 89 | tblastn |
| 441 | AF183904_T1 | *petunia* | 708 | 148 | 92 | tblastn |
| 442 | DW177184_T1 | *petunia* | 709 | 139 | 87 | tblastn |
| 443 | CO730856_T1 | pineapple | 710 | 148 | 88 | tblastn |
| 444 | CO731353_T1 | pineapple | 711 | 148 | 87 | tblastn |
| 445 | CO731804_T1 | pineapple | 712 | 186 | 89 | tblastn |
| 446 | DT338785_T1 | pineapple | 713 | 148 | 89 | tblastn |
| 447 | AA739732_T1 | pine | 714 | 152 | 87 | tblastn |
| 448 | CO363003_T1 | pine | 715 | 152 | 87 | tblastn |
| 449 | AI161898_T1 | poplar | 716 | 148 | 94 | tblastn |
| 450 | AI161898_T2 | poplar | 717 | 148 | 93 | tblastn |
| 451 | AI161898_T3 | poplar | 718 | 148 | 94 | tblastn |
| 452 | AI161961_T1 | poplar | 719 | 148 | 94 | tblastn |
| 453 | AI161961_T2 | poplar | 719 | 148 | 94 | tblastn |
| 454 | AI161961_T3 | poplar | 720 | 148 | 92 | tblastn |
| 455 | AI161961_T4 | poplar | 720 | 148 | 92 | tblastn |
| 456 | AI162478_T1 | poplar | 721 | 152 | 87 | tblastn |
| 457 | AI162845_T1 | poplar | 722 | 186 | 94 | tblastn |
| 458 | BI122785_T1 | poplar | 723 | 148 | 90 | tblastn |
| 459 | BU813699_T1 | poplar | 724 | 148 | 89 | tblastn |
| 460 | BU813699_T2 | poplar | 724 | 148 | 89 | tblastn |
| 461 | BU836906_T1 | poplar | 725 | 186 | 93 | tblastn |
| 462 | BU875572_T1 | poplar | 726 | 139 | 85 | tblastn |
| 463 | BU875572_T2 | poplar | 726 | 139 | 85 | tblastn |
| 464 | CV228249_T1 | poplar | 727 | 224 | 88 | tblastn |
| 465 | CV237204_T1 | poplar | 728 | 152 | 86 | tblastn |
| 466 | CV237204_T2 | poplar | 728 | 152 | 86 | tblastn |
| 467 | BE344367_T1 | potato | 729 | 148 | 91 | tblastn |
| 468 | BG593676_T1 | potato | 730 | 245 | 89 | tblastn |
| 469 | BG597337_T1 | potato | 731 | 148 | 90 | tblastn |
| 470 | BG598410_T1 | potato | 732 | 247 | 97 | tblastn |
| 471 | BG598410_T2 | potato | 733 | 247 | 97 | tblastn |
| 472 | BG888799_T1 | potato | 734 | 152 | 88 | tblastn |
| 473 | BQ118661_T1 | potato | 735 | 139 | 85 | tblastn |
| 474 | BQ118661_T2 | potato | 736 | 139 | 85 | tblastn |
| 475 | BQ516531_T1 | potato | 737 | 148 | 91 | tblastn |
| 476 | CK851382_T1 | potato | 738 | 148 | 91 | tblastn |
| 477 | CN212590_T1 | potato | 739 | 251 | 93 | tblastn |
| 478 | CN212590_T2 | potato | 739 | 251 | 93 | tblastn |
| 479 | AF327517_T1 | rice | 740 | 186 | 86 | tblastn |
| 480 | BI118688_T1 | rice | 741 | 152 | 85 | tblastn |

TABLE 8-continued

Significantly homologous polypeptides to the cotton improving genes

| Nucleotide SEQ ID NO: | Cluster name | Organism | Polypeptide SEQ ID NO: | Homology to SEQ ID NO | % Identity | Algorithm |
|---|---|---|---|---|---|---|
| 481 | BI795939_T1 | rice | 742 | 148 | 85 | tblastn |
| 482 | U38037_T1 | rice | 743 | 152 | 85 | tblastn |
| 483 | U38037_T2 | rice | 743 | 152 | 85 | tblastn |
| 484 | BQ104946_T1 | rose | 744 | 148 | 92 | tblastn |
| 485 | EC586289_T1 | rose | 745 | 186 | 89 | tblastn |
| 486 | EC588463_T1 | rose | 746 | 148 | 88 | tblastn |
| 487 | BU669008_T1 | sesame | 747 | 148 | 94 | tblastn |
| 488 | AW285608_T1 | *sorghum* | 748 | 152 | 86 | tblastn |
| 489 | BE592644_T1 | *sorghum* | 749 | 152 | 87 | tblastn |
| 490 | BE595956_T1 | *sorghum* | 750 | 184 | 91 | tblastn |
| 491 | AW349054_T1 | soybean | 751 | 186 | 86 | tblastn |
| 492 | AW349285_T1 | soybean | 752 | 148 | 87 | tblastn |
| 493 | AW349636_T1 | soybean | 753 | 152 | 92 | tblastn |
| 494 | AW569132_T1 | soybean | 754 | 152 | 92 | tblastn |
| 495 | BE352761_T1 | soybean | 755 | 187 | 89 | tblastn |
| 496 | BE659353_T1 | soybean | 756 | 139 | 85 | tblastn |
| 497 | BE659353_T2 | soybean | 756 | 139 | 85 | tblastn |
| 498 | BE661354_T1 | soybean | 757 | 148 | 89 | tblastn |
| 499 | BI969429_T1 | soybean | 758 | 152 | 93 | tblastn |
| 500 | BI971168_T1 | soybean | 759 | 148 | 88 | tblastn |
| 501 | CA852085_T1 | soybean | 760 | 186 | 86 | tblastn |
| 502 | CD390653_T1 | soybean | 761 | 148 | 93 | tblastn |
| 503 | AF051246_T1 | spruce | 762 | 152 | 87 | tblastn |
| 504 | AF051246_T2 | spruce | 762 | 152 | 87 | tblastn |
| 505 | CA069331_T1 | sugarcane | 763 | 152 | 87 | tblastn |
| 506 | CA106361_T1 | sugarcane | 764 | 152 | 86 | tblastn |
| 507 | CA118153_T1 | sugarcane | 765 | 186 | 86 | tblastn |
| 508 | CD851311_T1 | sunflower | 766 | 152 | 90 | tblastn |
| 509 | CD851311_T2 | sunflower | 766 | 152 | 90 | tblastn |
| 510 | CX943625_T1 | sunflower | 767 | 148 | 85 | tblastn |
| 511 | DY914967_T1 | sunflower | 768 | 152 | 90 | tblastn |
| 512 | DN772748_T1 | thellungiella | 769 | 148 | 89 | tblastn |
| 513 | BP130889_T1 | tobacco | 770 | 247 | 86 | tblastn |
| 514 | BP136053_T1 | tobacco | 771 | 152 | 89 | tblastn |
| 515 | BP136053_T2 | tobacco | 771 | 152 | 89 | tblastn |
| 516 | CV017679_T1 | tobacco | 772 | 148 | 90 | tblastn |
| 517 | CV017893_T1 | tobacco | 773 | 148 | 92 | tblastn |
| 518 | CV019967_T1 | tobacco | 774 | 148 | 90 | tblastn |
| 519 | CV020081_T1 | tobacco | 775 | 224 | 86 | tblastn |
| 520 | CV021812_T1 | tobacco | 776 | 148 | 89 | tblastn |
| 521 | EB424751_T1 | tobacco | 777 | 148 | 87 | tblastn |
| 522 | EB426768_T1 | tobacco | 778 | 148 | 92 | tblastn |
| 523 | BG124262_T1 | tomato | 779 | 148 | 90 | tblastn |
| 524 | BG126286_T1 | tomato | 780 | 148 | 91 | tblastn |
| 525 | BG127143_T1 | tomato | 781 | 152 | 88 | tblastn |
| 526 | BG133022_T1 | tomato | 782 | 224 | 86 | tblastn |
| 527 | BG629194_T1 | tomato | 783 | 148 | 89 | tblastn |
| 528 | BG643389_T1 | tomato | 784 | 186 | 88 | tblastn |
| 529 | BE398818_T1 | wheat | 785 | 152 | 86 | tblastn |
| 530 | BE403180_T1 | wheat | 786 | 152 | 85 | tblastn |
| 531 | BE490465_T1 | wheat | 787 | 152 | 85 | tblastn |
| 532 | BF202079_T1 | wheat | 788 | 186 | 86 | tblastn |
| 533 | BF484998_T1 | wheat | 789 | 229 | 93 | tblastn |
| 534 | BQ806763_T1 | wheat | 790 | 152 | 85 | tblastn |
| 535 | CA610895_T1 | wheat | 791 | 152 | 86 | tblastn |

Table 8: Significantly homologous polypeptides to the cotton improving genes.

Example 5

Cloning of the Selected Genes Ina Binary Vector Under Constitutive Regulation and Recombinant Expression of Same Bioinformatics Analysis Open Reading Frame (ORF) analysis—Gene sequences of the present study were analyzed for ORFs using Gene Runner software version 3.05 [Hasting Software, Inc: World Wide Web(dot)generunner(dot)com/]. ORFs of each gene were compared to Genbank database, using Blast [World Wide Web(dot)ncbi(dot)nlm(dot)nih(dot)gov/BLAST/]. By comparing to the highest homologous ORFs, the position of the ATG initiation codon was determined. All the sequences described herein were shown to have a predicted full length ORF and to include the predicted ATG starting codon.

Experimental Procedures and Results

Cloning into the pPI/pGI expression vector—For cloning the genes of the present study, total RNAs from the various developmental stages of fiber producing cells was extracted, using Hot Borate RNA Extraction from Cotton Tissue grown in Rehovot, Israel, according to World Wide Web(dot)eeob (dot)iastate(dot)edu/faculty/WendelJ/rnaextraction(dot) html. Complementary DNA (cDNA) molecules were produced from mRNA using M-MuLV reverse-transcriptase (RT) enzyme (Roche) and T$_{16}$NN DNA primer, following protocol provided by the manufacturer. cDNA amplification was done for 19 genes, out of the sequences above, namely CTF clones: CTF101, CTF110, CTF111, CTF113, CTF124, CTF132, CTF135, CTF162, CTF165, CTF166, CTF167, CTF169, CTF171, CTF172, CTF173, CTF175, CTF176, CTF177 and CTF178 (SEQ ID NOs:1-17, 22 and 37; Table 7 hereinabove) by PCR using PFU proof reading DNA polymerase enzyme [Promega, World Wide Web(dot)promega(dot)com/pnotes/68/7381_07/7381_07(dot)html] following the protocol provided by the manufacturer. Primers for each gene were designed to span the full ORF. Additional restriction endonuclease sites were added to the 5' end of each primer to facilitate further cloning of the CTFs to the binary vector (pPI). Table 9 below, lists the primers used for cloning each of the genes:

TABLE 9

Primers used to clone each of the genes

| CTF No. | Forward Primer/ SEQ ID NO: | Reverse Primer SEQ ID NO: | upstream restriction site | downstream restriction site |
|---|---|---|---|---|
| CTF 101 | CACCCGGGACCACCATC AAACCACATCC/801 | GAGAGCTCTCCAAAATTGAC ACACCAGG/802 | Sma | Sac |
| CTF 110 | AACCCGGGTTCCCTTTCC AAGCTTCAGC/803 | CACCCGGGTACCTAAAGTTG CAGCTTGC/804 | Sma | Sma |
| CTF 111 | TTCCCGGGTTGCCTTTTT GTCATTTCCC/805 | CAGAGCTCTTGTTTATGAATC CACTTTGGG/806 | Sma | Sac |
| CTF 113 | GACCCGGGAAACGATGG AGGATCTTGCC/807 | CAGAGCTCTTGGAATTGAAA TGTCATTACAGAG/808 | Sma | Sac |
| CTF 124 | TTCCCGGGCACTCTTCAT TCCTCACCTACTC/809 | TTGAGCTCTGGATTTCTGAAA ACAACCG/810 | Sma | Sac |
| CTF 132 | AACCCGGGCACCACCTC CACTCACCTTC/811 | TTGAGCTCTGCTCTTATATCA TGTGAAGGC/812 | Sma | Sac |
| CTF 135 | CACCCGGGAACTCTTCA AGACCATTCGAC/813 | ACGAGCTCAGCTAGATAAAT CACAACCATCC/814 | Sma | Sac |
| CTF 162 | TGCCCGGGTTCAGCGTT CGAATCCATG/815 | GTGAGCTCTGCCTGACACATT GACATGC/816 | Sma | Sac |
| CTF 165 | CTCCCGGGTTTGAAGCT CAGGAACTAATGG/817 | TTGAGCTCAGGGACCAATTT GTTGCCA/818 | Sma | Sac |
| CTF 166 | ACGATATCAAGAATCCG ACCCGGTAAC/819 | CTGAGCTCGGAAGTAAATTT GGACACTCG/820 | EcoRV | Sac |
| CTF 167 | AACCCGGGCCCTAAGAT GACAAACCAAGA/821 | TGGAGCTCAATAATCATGTG GCAGTAGTTTG/822 | Sma | Sac |
| CTF 169 | GACCCGGGAAACATGGA AGGAGACGATG/823 | CGGAGCTCAAAAGCATTCAG AACAACCAG/824 | Sma | Sac |
| CTF 171 | AGCCCGGGAAACATGTT TGCAGGAGATCAG/825 | AGGAGCTCAATTACAACCAA AGGTTAACCC/826 | Sma | Sac |
| CTF 172 | ACCCCGGGGAGCTCTGG ATACAGTTAAGAATC/827 | CTCCCGGGTAGACTTGTAGT AAAGCATGTATCC/828 | Sma | Sma |
| CTF 173 | ATCCCGGGAGTTAACTG GTCTCTTCTGATGTC/829 | TCGAGCTCAACAACTATACC AGTCATTGCTTC/830 | Sma | Sac |
| CTF 175 | AGGATATCTTTCGATCA CCGTGATGGC/831 | GCGAGCTCGTAGTGACGTCA CCGGTTC/832 | EcoRV | Sac |
| CTF 176 | GACCCGGGAGACACACA AAGCGAGAAGG/833 | AAGAGCTCTATCACTTACATC CTAGGCAGC/834 | Sma | Sac |
| CTF 177 | TTTCCCGGGTCTGGCTTG AAAATGGTGTG/835 | AAGAGCTCGCATTGAACTTC ATCATCTGTAAG/836 | Sma | Sac |
| CTF 178 | CGCCCGGGTTTTTCCAA CTAAGGTTAGGC/837 | CACCCGGGCCAATAAACAAT AGCACTGC/838 | Sma | Sma |

The resultant PCR blunt ended products were purified using PCR Purification Kit (Qiagen, Germany), digested with the appropriate restriction endonucleases (Roche) and cloned into the pPI or pGI binary vector (FIG. 1), while replacing the existing GUS reporter gene. pPI is a modified version of pBI101.3 (Clontech, Accession No. U12640). pPI was constructed by inserting a synthetic poly-(A) signal sequence, which originated from pGL3 Basic plasmid vector (Promega, GenBank Accession No. U47295, where the synthetic poly-(A) signal sequence is located between nucleotides 4658-4811), into the HindIII restriction site of pBI01.3 [while reconstituting the HindIII site, downstream to the poly-(A) insert], to avoid the possibility of read-through effect of the upstream Nos-promoter. In some cases the backbone binary plasmid used was pGI which is similar to pPI but the GUS gene was replaced by the GUS-Intron gene (Vancanneyt. G, et al MGG 220, 245-50, 1990). To replace the GUS/GUS-Intron gene with each one of the CT genes in the pPI/pGI binary vector, pPI/pGI was digested with the appropriate restriction enzymes [5' prime restriction enzyme is either SmaI or XbaI and 3' prime restriction enzyme is either SacI or EcoRV (Roche-using the protocol provided by the manufacturer)]. Open binary vector was purified using PCR Purification Kit (Qiagen, Germany). 5-75 ng of PCR product of each of the CTF genes and 100 ng of open pPI/pGI plasmid vector were ligated in 10 µL ligation reaction volume using T4 DNA ligase enzyme (Roche), following the protocol provided by the manufacturer. Ligation products were introduced into $E.$ $coli$ cells.

Recombinant expression in bacteria—60 µl of $E.$ $coli,$ strain DH5-α competent cells (about $10^9$ cells/ml) were transformed using 1 µl of ligation reaction mixture by electroporation, using a MicroPulser electroporator (Biorad), 0.2 cm cuvettes (Biorad) and EC-2 electroporation program (Biorad). $E.$ $coli$ cells were grown on 0.8 ml LB liquid medium at 37° C. for 1 hour and 0.2 ml of the cell suspension were plated on LB-agar plates supplemented with the antibiotics kanamycin 50 mg/L (Sigma). Plates were then incubated at 37° C. for 16 hours. Bacteria colonies were grown and expression was confirmed by PCR amplification using primers which were designed to span the inserted sequence in the binary vector. Primers used for DNA amplification of the inserts in the pPI binary vector were: 5'-GGTGGCTCCTACAAATGCCATC-3' (forward, SEQ ID NO:839) and 5'-AAGTTGGG-TAACGCCAGGGT-3' (reverse, SEQ ID NO:840).

PCR products were separated on 1.5% agarose gels and product sizes were estimated by comparing to DNA ladder (MBI Fermentas). PCR products with the predicted size were sequenced using the same primers previously used for PCR amplification (See Table 9, above).

Additional primers, which were designed based on the sequence of each gene insert, were used to complete the sequencing of the full length ORF insert.

Sequencing of the inserted sequence was performed to verify that the clones were introduced in the right orientation, and to eliminate the possibility that sequence errors were included during PCR amplification. DNA sequences were determined using ABI 377 sequencer (Amersham Biosciences Inc). The cloned cDNA sequences of 17 cotton genes are provided (SEQ ID NOs:906-922), as well as their deduced amino acid sequences (SEQ ID NOs:923-939). In most cases, minute changes were found between the bioinformatically predicted sequence and the cloned ones, probably due to allelic variations and sequence quality of the ESTs in the database.

Into each one of the 19 pPI/pGI binary constructs harboring the CTF genes, the constitutive Cauliflower Mosaic Virus 35S promoter was cloned.

Cauliflower Mosaic Virus 35S promoter sequence (SEQ ID NO:841), originated from the pBI121 vector (Clontech, GenBank Accession No. AF485783) was cloned by digesting the pBI121 vector with the restriction endonucleases HindIII and BamHI (Roche) and ligated into the binary constructs, digested with the same enzymes.

Example 6

Agrobacterium Transformation of Binary Plasmids Harboring the Genes of Interest and Expression in Tomato Plants In a previous study the present inventors have demonstrated the potential of using tomato seed hair as a model for cotton fiber (PCT IL2005/000627). Thus, to demonstrate the effect of the isolated fiber improving genes of the present study on fiber growth, tomato plants were transformed with the binary vectors comprising the isolated cotton genes under the transcriptional regulation of the 35S promoter. Each of the nineteen binary constructs, comprising the 35S promoter upstream of each of the CTFs genes was transformed into tomato plants via *Agrobacterium tumefacience* transformation, as follows.

Experimental Procedures and Results

Transformation of the binary constructs comprising the 35S promoter upstream of the CTF genes into tomato plants via *Agrobacterium tumefacience*-60 µl of *Agrobacterium tumefaciens* GV301 or LB4404 competent cells (about $10^9$ cells/ml) were transformed with 20 ng of binary plasmid via electroporation, using a MicroPulser electroporator (Biorad), 0.2 cm cuvettes (Biorad) and EC-2 electroporation program (Biorad).

*Agrobacterium* cells were grown on 0.8 ml LB liquid medium at 28° C. for 3 hours and 0.2 ml of the cell suspension were plated on LB-agar plates supplemented with the antibiotics gentamycin 50 mg/L (for *Agrobacterium* strains GV301) or streptomycin 300 mg/L (for *Agrobacterium* strain LB4404) and kanamycin 50 mg/L (Sigma). Plates were then incubated at 28° C. for 48 hours. *Agrobacterium* colonies were grown and PCR amplification was performed on *Agrobacterium* cells, using primers which were designed to span the inserted sequence in the binary vector.

Primers used for PCR amplification were: 5'-GGTG-GCTCCTACAAATGCCATC-3' (forward, SEQ ID NO:839) and 5'-AAGTTGGGTAACGCCAGGGT-3' (reverse, SEQ ID NO:840).

PCR products were separated on 1.5% agarose gels and product sizes were determined by comparing to DNA ladder (MBI Fermentas). PCR products with the predicted size were sequenced using the primers which were used for the PCR amplification. Sequencing of the inserted sequence was performed using the ABI 377 sequencer (Amersham Biosciences Inc.) in order to verify that the right clones were introduced into the *Agrobacterium* cells.

Transformation of Micro-Tom tomato plants with putative cotton genes—Tomato (*Lycopersicon esculentum*, var MicroTom) transformation and cultivation of transgenic plants was effected according to Curtis et al. 1995, and Meissner et. al. 2000, with slight modifications.

Example 7

Growth of Microtom Transformed Plants and Phenotype Characterizations

Experimental Procedures

Producing transgenic tomato plants—Plants were transformed as described in Example 6, above. Following transformation, T1 MicroTom tomato plants were grown in a mix that contained in 1000 ml pots until fruit set. The tomato seed hair length was measured.

Experimental Results

The micro-Tom tomato seeds (T2, origin from T1 plants), which carry the putative cotton genes following the transformation with *Agrobacterium* cells carrying the CTF genes, were analyzed (Table 10, hereinbelow). Least Sq mean are the predicted values corresponding to some combination of levels, after setting all the other factors to some neutral value (JMP™ V5). For each gene, the overall mean influence of the gene (least Sq mean), and the event that gave the best results (Best event), which can pinpoint on the potential of the gene, is shown in Table 10, hereinbelow. we demonstrate the results of. The letters "A, B and C" refer to genes that are significantly different from each other at $P<0.05$.

TABLE 10

Analysis of Micro-Tom tomato seeds carrying the putative cotton genes

| Gene | Number of independent events | Least Sq Mean | Significant (t-Test compare to wt) | % compare to wt | Best event | % of Best event compare to wt |
|---|---|---|---|---|---|---|
| CTF165 | 10 | 33.8 | A | 21 | 40.0 | 43 |
| CTF172 | 10 | 33.2 | A | 19 | 36.3 | 30 |
| CTF167 | 9 | 32.5 | A | 16 | 42.7$^a$ | 53 |
| Expansin (SEQ ID NO: 905) | 8 | 32.0 | A | 15 | 35.0 | 25 |
| CTF178 | 7 | 31.9 | A | 14 | 38.3 | 37 |
| CTF135 | 8 | 30.8 | A | 10 | 37.3 | 34 |
| CTF124 | 9 | 30.0 | B | 7 | 31.7 | 13 |
| CTF169 | 11 | 29.9 | B | 7 | 39.3$^b$ | 41 |
| CTF166 | 9 | 29.8 | B | 7 | 36.0$^b$ | 29 |
| CTF111 | 8 | 28.8 | B | 3 | 35.0$^b$ | 25 |
| WT | — | 27.9 | B | 0 | | |
| CTF113 | 7 | 27.0 | B | −3 | 31.0 | 11 |
| CTF110 | 9 | 27.0 | B | −4 | 39.0$^b$ | 40 |
| CT101 | 7 | 23.4 | C | −16 | 26.0 | −7 |

Table 10: Analysis of Micro-Tom tomato seeds (T2, origin from T1 plants) carrying the putative cotton genes is presented.
$^a$Best event was significantly higher than expansin best event;
$^b$Best event was significantly higher than WT.

Example 8

Isolation, Cloning and Analysis of Cotton Fiber Specific Promoters

One of the important requirements for engineered plants is to activate the right gene in the right place. In order to improve fiber quality, a basic requirement for engineered plants is a promoter providing an expression pattern that is appropriate for fiber development. Constitutive promoters allow expression of preformed genes in which the effect of the protein is present continuously throughout the plant. The CaMV35S promoter from cauliflower mosaic virus is a widely used example. In order to improve cotton fiber quality, it is advantageous to combine target genes with fiber specific promoter, to avoid influence of the genes on the cell structure in other cotton tissues, and to activate the genes at the fiber tissue in the right development stage (initiation, elongation, maturation, fiber constitutive). The present inventors have selected and cloned the genomic sequence of novel cotton fiber promoters, as follows.

Experimental Procedures and Results

Cloning of promoter sequences of native cotton genes—The desired cotton promoters were chosen based on the expression profile of their encoded native genes. Expression profiles of the chosen 4 cotton genes CT4 (SEQ ID NO:842), CT9 SEQ ID NO:843), CT11 (SEQ ID NO:844) and CT74 (SEQ ID NO:845) are presented in FIGS. 2a-d.

The genomic sequence upstream of CT4, CT9, CT11, and CT74 were cloned from genomic DNA of cotton (*Gossypium barbdanse* L. var S5), as follows.

Total genomic DNA was extracted from plant leaf tissues of 4 week old cultivated cotton plants (*Gossypium barbdanse* L. var S5), using DNA extraction kit (Dneasy plant mini kit, Qiagen, Germany). For promoter isolation the BD GenomeWalker™ kit (BD Biosciences Clontech) was used. In addition to the 4 restriction enzymes used in the kit, the blunt end restriction enzymes SmaI, EcoRV and Ecl13611 were also used. For each promoter, a set of two specific primers were used for the first round:

```
Primers for CT4 promoter were as follows (UP-PCR):
External primer: CT4 GSP_R-
                                     (SEQ ID NO: 846)
5'-GTGGACCCTGAAACATACTCACCAGC-3';

Internal (Nested) primer: CT4 GSP_NR-
                                     (SEQ ID NO: 847)
5'-AAGCCATATTGCCAATGTCACTTCCTC-3';
```

For CT4 promoter the library was originated from StuI restriction enzyme.

The putative promoter sequence of CT4 cloned using the above procedure is set forth by SEQ ID NO:848.

```
Primers for CT74 promoter
were as follows (UP-PCR):
```

```
    External primer: CT74 GSP_R-
                                    (SEQ ID NO: 849)
    5'-GCATGAGGGTCAGGAGCTGGATAGTAG-3';

Internal (Nested) primer: CT74 GSP_NR-
                                    (SEQ ID NO: 850)
    5'-CTTCTTTGCCTCTCCATCTCTGTATGC-3'
```

For CT74 promoter the library was originated from DraI and PvuII restriction enzymes.

The putative promoter sequence of CT74 cloned using the above procedure is set forth by SEQ ID NO:851.

```
    Primers for CT11 promoter
    were as follows (UP-PCR):
    External primer: CT11 GSP_R-
                                    (SEQ ID NO: 852)
    5'-ACCTGAGGTATTTTGGTAAGAGTTCCG-3'.

Internal (Nested) primer: CT11 GSP_NR-
                                    (SEQ ID NO: 853)
    5'-CCAATTCAGCTTTCGGAAAATCACG-3'.
```

For CT11 promoter the library was originated from SmaI and StuI restriction enzymes.

The putative promoter sequence of CT11 cloned using the above procedure is set forth by SEQ ID NO:854.

```
Primers for CT9 promoter were as follows (UP-PCR):
External primer: CT9 GSP_R-
                                    (SEQ ID NO: 855)
5'-GGCATTTTTAAGATGTGAAACGTCGG-3'.

Internal (Nested) primer: CT9 GSP_NR-
                                    (SEQ ID NO: 856)
5'-GCTCGACTTTGGGTGGACATGTATGTAG-3'.
```

For CT9 promoter the library was originated from DraI and SmaI restriction enzymes.

The putative promoter sequence of CT9 cloned using the above procedure is set forth by SEQ ID NO:857.

PCR products were purified using PCR purification kit (Qiagen) and sequencing of the amplified PCR products was performed, using ABI 377 sequencer (Amersham Biosciences Inc).

For cloning the putative promoters and 5' UTRs, PCR amplification was carried out using a new set of primers (below) to which 8-12 bp extension that included one restriction site (HindIII, SalI, XbaI, BamHI, or SmaI) on the 5' end. For each promoter, restriction sites that do not exist in the promoter sequence were selected. Moreover, the restriction sites in the primer sequences were designed so the resultant PCR products were cloned into the binary vector pPI or pGI (see Example 5 above) in the right orientation, upstream of the GUS reporter gene.

Following are the primers used for promoter and 5' UTR (P+U) amplification and cloning into pPI.

```
    CT74_1000:
    CT74-pro-F-H (HindIII):-
                                    (SEQ ID NO: 858)
    5'-ATACAAGCTTGTTGAGGGAGATTGATTTCTTTGG-3';
    and
    CT74-pro-R-SL (SalI):-
                                    (SEQ ID NO: 859)
    5'-CAAAGTCGACAAGATTGGAAGATGTGTGAGTTGAG-3'.

CT74_1400:
    CT74-pro-F-H-2 (HindIII):-
                                    (SEQ ID NO: 860)
    5'-TGTTAAGCTTGTAAAATCACAGGCTAACTATCACTC-3';
    and
                                    (SEQ ID NO: 859)
    CT74-pro-R-SL (SalI):.

CT74_1700:
    CT74_proF_H_3 (HindIII):-
                                    (SEQ ID NO: 861)
    5'-GTCGAAGCTTTGGTCTGTCCGGATCACTGTG-3';
    and
                                    (SEQ ID NO: 859)
    CT74-pro-R-SL (SalI):.

CT4_1000:
    CT4-pro-F-H (HindIII):-
                                    (SEQ ID NO: 862)
    5'-ACTTAAGCTTGGTAAAACTTCAACTTGCCTTTG-3';
    and
    CT4-pro-R-SL (SalI):-
                                    (SEQ ID NO: 863)
    5'-CAAAGTCGACTTGCCAATGTCACTTCCTCCC-3'.

CT4_1400:
    CT4_pro_F_H_2 (HindIII):-
                                    (SEQ ID NO: 864)
    5'-CAACAAGCTTAGCATGCCACTTTTCACCATC-3';
    and
                                    (SEQ ID NO: 863)
    CT4-pro-R-SL (SalI):.

CT11_730:
    CT11proFSL(SalI):-
                                    (SEQ ID NO: 865)
    5'-ATATGTCGACATTGAGGCCATTAAAGTTCATC-3';
    and
    CT11_pro_R_Xb (XbaI):-
                                    (SEQ ID NO: 866)
    5'-CATTCTAGATCTCTTTGATCACTTGCACCTG-3'

CT9_650:
    CT9_pro_F_H (HindIII):-
                                    (SEQ ID NO: 867)
    5'-TTCGAAGCTTGTCTCCCGTCTAAACTTATCCTG-3';
    and
    CT9_pro_R_SL (SalI):-
                                    (SEQ ID NO: 868)
    5'-AGGAGTCGACCATGTATGTAGTAATGATAGCAGCTG-3'.
```

Genomic DNA or the IPCR/UP-PCR product was used as DNA template for PCR-amplification, using the newly designed oligonucleotide primers. PCR products were purified (PCR Purification Kit, Qiagen, Germany) and digested with the restriction sites exist in the primers (Roche, Switzerland). The digested PCR products were re-purified and cloned into the binary vector pPI/pGI, which was digested with the same restriction enzymes. PCR product and the open plasmid vector were ligated using T4 DNA ligase enzyme (Roche, Switzerland).

Example 9

Transforming *Agrobacterium tumefacience* Cells with Binary Vectors Harboring Cotton Fiber Promoters pPI/pGI Binary vector, including either CT4, CT11, CT9 or CT74 promoter, upstream to the GUS reporter gene were used to transform *Agrobacterium* cells.

Experimental Procedures and Results

Transformation of binary vectors including cotton fibers promoters into *Agrobacterium tumefaciens*—The binary vectors were introduced to *Agrobacterium tumefaciens* GV301, or LB4404 competent cells (about $10^9$ cells/ml) by electroporation. Electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Agrobacterium* colonies which developed on the selective media were analyzed by PCR using the primers set forth in SEQ ID NO:869 101F: 5'-GCTATGAC-CATGATTACGCC-3' and SEQ ID NO:870 GUSREV: 5'-CTGCATCGGCGAACTGATCG-3', which were designed to span the inserted sequence in the pPI/pGI plasmid. The resulting PCR products were isolated and sequenced, to verify that the correct sequences were properly introduced to the *Agrobacterium* cells.

Example 10

Cotton Fiber Specific Promoters are Expressed in Tomato Leaves and Fruits, and in *Arabidopsis* and Cotton Plants To illustrate specific expression in *arabidopsis* and tomato trichomes and in tomato fruits, GUS staining was performed on transformed plants, as follows.

Experimental Procedures

Transformation of Micro-Tom tomato plants with putative cotton promoters—Tomato (*Lycopersicon esculentum*, var MicroTom) transformation and cultivation of transgenic plants was performed according to Curtis et al. 1995, and Meissner et. al. 2000.

Transformation and cultivation of *Arabidopsis thaliana* plants with putative cotton promoters—*Arabidopsis thaliana* Columbia plants (T0 plants) were transformed using the Floral Dip procedure described by Clough and Bent (1998) and by Desfeux et al. (2000), with minor modifications. Briefly, T0 Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The T0 plants were ready for transformation six days prior to anthesis. Single colonies of *Agrobacterium* carrying the binary constructs, were cultured in LB medium supplemented with kanamycin (50 mg/L) and gentamycin (50 mg/L). The cultures were incubated at 28° C. for 48 hours under vigorous shaking and then centrifuged at 4,000 rpm for 5 minutes. The pellets comprising *Agrobacterium* cells were re-suspended in a transformation medium containing half-strength (2.15 g/L) Murashig-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7. Transformation of T0 plants was effected by inverting each plant into an *Agrobacterium* suspension, such that the above ground plant tissue was submerged for 3-5 seconds. Each inoculated T0 plant was immediately placed in a plastic tray, then covered with clear plastic dome to maintain humidity and was kept in the dark at room temperature for 18 hours, to facilitate infection and transformation. Transformed (i.e., transgenic) plants were then uncovered and transferred to a greenhouse for recovery and maturation.

The transgenic T0 plants were grown in the greenhouse for 3-5 weeks until siliques were brown and dry. Seeds were harvested from plants and kept at room temperature until sowing. For generating T1 transgenic plants harboring the genes, seeds collected from transgenic T0 plants were surface-sterilized by soaking in 70% ethanol for 1 minute, followed by soaking in 5% sodium hypochloride and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital T1 *Arabidopsis* plants were transferred to a fresh culture plates for another week of incubation. Following incubation the T1 plants were removed from culture plates and planted in growth mix contained in 250 ml pots. The transgenic plants were allowed to grow in a greenhouse to maturity.

Transformation of cotton tissues with putative cotton promoters—The newly cloned cotton promoters could be evaluated directly in cotton plants by transforming the cloned binary vectors into cotton tissues for either transient expression (Kim H J, Triplett B A. 2001), or stable gene transformation, by using commonly used protocols.

GUS staining—Gus staining of *arabidopsis* and tomato plants was performed according to a routine protocol described elsewhere (Jefferson R A. et. al. 1987, Meissner et. al. 2000). Briefly, leaves are fixed in 90% ice cold acetone for 15-20 minutes (on ice), followed by removing acetone, rinsing tissue with the Working Solution [25 mM Sodium Phosphate (Sigma, USA) buffer pH=7, Ferricyanide (Sigma, USA) 1.25 mM, Ferrocyanide (Sigma, USA) 1.25 mM, Triton X-100 (Sigma, USA) 0.25%, EDTA (BioLab, Israel) 0.25 mM] for 15-20 minutes (repeat twice). Rinse solution is removed, replaced with Staining solution [Working solution with 5-bromo-4-chloro-3-indolyl-β-D-glucuronic acid (X-GlcA, Duchefa) solubilized in N,N-Dimethylformamide (BioLab, Israel) 1.5 mg/ml and Dithiothreitol (DTT, Bio Lab) 100 mM] in dark (tubes wrapped with aluminum foil) and incubated over night at 37° C. Distaining is carried by sinking the plant tissue in 70% ethanol and heating at 50° C. for about 2 hours. Distaining step is repeated until the plant tissue becomes transparent except the blue stained regions. Distained plants are stored in 70% ethanol (BioLab, Israel) at room temperature.

Experimental Results

Table 11, hereinbelow, summarizes the information on the cotton gene clusters and their cloned and evaluated promoters used by the present inventors.

TABLE 11

| Cotton gene clusters and cloned promoters | | | | | | |
|---|---|---|---|---|---|---|
| Promoter | ORF-Annotation | Tissue Specificity | Expression Level | Expression Description | Promoter Origin | Promoter Length |
| CT4 | Cytochrome P450 | Fiber specific | medium | Expressed during all fiber development stages | *G. barbdanse* L. var S5 | 1400 |

TABLE 11-continued

Cotton gene clusters and cloned promoters

| Promoter | ORF-Annotation | Tissue Specificity | Expression Level | Expression Description | Promoter Origin | Promoter Length |
|---|---|---|---|---|---|---|
| CT74 | Protodermal factor 1 (PDF1), | Fiber specific | high | Expressed during all fiber development stages | G. barbdanse L. var S5 | 1000 |

GUS staining on T1 Arabidopsis plants—GUS was expressed under the regulation of CT4 and CT74, promoters in the genetically transformed Arabidopsis plants. As shown in FIGS. 3a-f high level of expression was obtained in the leafs of Arabidopsis plants under the control of the CT4 (FIG. 3b) or CT74 (FIG. 3c) promoters as well as in the root tips under the control of the CT74 promoter (FIG. 3f).

GUS staining on T1 tomato plants—Results for tomato T1 generation are summarized in the Table 12, below.

TABLE 12

Arabidopsis - Reporter gene expression regulated by the two novel promoters compared to 35S promoter

| | Average Intensity | | | | |
|---|---|---|---|---|---|
| Promoter | Leaf | Leaf trichome | Pore | Root | Root Tips |
| CT4 SEQ ID NO: 848 | 0 | 1 | 3 | 0 | 0 |
| CT74 SEQ ID NO: 851 | 1 | 2 | 5 | 0 | 5 |
| 35S SEQ ID NO: 841 | 4 | 2 | 2 | 5 | 5 |

Table 12: The intensity levels of expression represent an average of 4 independents events and are expressed by arbitrary numbers from 1 to 5, where 1 = low expression, and 5 = highest intensity, as was estimated by two independent observers.
ND—not determined.

As shown in Table 12, a high level of expression is obtained under the control of CT4 promoter in the pores. In addition, a high level of expression is obtained under the control of the CT74 promoter in the root tips and pores, and a moderate level of expression is obtained in the leaf trichomes.

Altogether, these results demonstrate the isolation of a set of cotton fiber specific promoters which allow expression of the candidate genes at the right time and right strength. Thus, the four new fiber specific promoters which were identified, isolated and characterized in the present study exhibit different levels of expression: very high (CT74), high (CT9), moderate (CT4) and low expression (CT11). These promoters were shown to represent different patterns of expression: initiation (CT4), elongation (CT9 and CT74) and constitutive expression (CT11).

Example 11

Agroinjection of Cotton Developed Balls—A New Tool for Rapid Analysis of Genes and Promoters Directly in Developed Fibers In order to demonstrate fiber related gene expression, the genes should be over-expressed in the relevant tissue, the ovule. To-date, a transient expression system, which uses natural grown cotton ovules/fibers, does not exist. The present inventors have devised a method of infecting cotton ovule cells using agroinjection in order to demonstrate over expression of fiber related genes on fiber development, as follows.

Briefly, the assay is based on the co-expression of a marker gene and a tested gene. A green-fluorescent-protein (GFP) (SEQ ID NO:871) or GUS-intron (GUSint, SEQ ID NO:872) as a reporter gene is cloned under regulation of CT2 fiber specific promoter (SEQ ID NO:873) (disclosed in PCT Patent Appl. No IL2005/000627 to Evogene Ltd.) in cis to the tested fiber related genes CT1, 2, 3, 6, 7, 9, 11, 20, 22, 27, 40, 71, 74, 75, 76, 81, 82, 84, and 4 (SEQ ID NOs:874-892) (disclosed in PCT Patent Appl. No IL2005/000627 to Evogene Ltd.) under regulation of the constitutive CaMV 35S promoter (SEQ ID NO:841). Expression of the reporter gene pinpoints on the fibers that were successfully transformed with the construct. Those "reporter-positive" fibers are analyzed for fiber characteristics. The binary vector backbone is pBI101.3 (Clontech, Accession No. U12640).

Experimental Procedures

I. Cloning of the Selected Genes in a Binary Vector Under Constitutive Regulation and in Cis to CT2promoter::GFP Recombinant Expression:

Cloning GFP into the pGI expression vector—For cloning the GFP gene, primers for the GFP gene were designed to span the full ORF from the binary vector pGFP(+ATG)+35S. Additional restriction endonuclease sites were added to the 5' end of each primer (GFP_ORF_F_Sm2 and GFP_R_Sc) to facilitate further cloning of the GFP to the binary vector (pGI). Primers used for PCR amplification were: GFP_OR-F_F_Sm2: 5'-GACCCGGGAAACAATGAGTAAAG-GAGAAGAAC-3' (forward, SEQ ID NO:893); and GFP_R_Sc: 5'-TTGAGCTCTCATCAGGTTGACTTGTAT-AGTTCATCCATG-3' (reverse, SEQ ID NO:894).

The resultant PCR blunt ended products were purified using PCR Purification Kit (Qiagen, Germany), digested with SmaI/SacI restriction endonucleases (Roche) and cloned into the pGI binary vector (FIG. 1), while replacing the existing GUSint reporter gene. pGI is a modified version of pBI101.3 (Clontech, Accession No. U12640). pGI was constructed by inserting a synthetic poly-(A) signal sequence, which originated from pGL3 Basic plasmid vector (Promega, GenBank Accession No. U47295, where the synthetic poly-(A) signal sequence is located between nucleotides 4658-4811), into the HindIII restriction site of pBI101.3 (while reconstituting the HindIII site, downstream to the poly-(A) insert), to avoid the possibility of read-through effect of the upstream Nos-promoter and replace GUS for GUSint. To replace the GUSint gene with the GFP gene in the pGI binary vector, pGI was digested with the appropriate restriction enzymes [5' prime restriction SmaI and 3' prime restriction enzyme SacI (Roche-using the protocol provided by the manufacturer)]. Open binary vector was purified from the gel using NucleoTrap kit (Macherey-Nagel). 5-75 ng of a PCR product of the GFP gene and 100 ng of open pGI plasmid vector were ligated in 10 µl ligation reaction volume using T4 DNA ligase enzyme (Roche), following the protocol provided by the manufacturer. Ligation products were introduced into E. coli cells. The new constructs were designated pGFP(-35S).

Recombinant expression in bacteria—60 μl of E. coli, strain DH5-α competent cells (about 10⁹ cells/ml) were transformed using 1 μl of ligation reaction mixture by electroporation, using a MicroPulser electroporator (BioRad), 0.2 cm cuvettes (BioRad) and EC-2 electroporation program (BioRad). E. coli cells were grown on 1 ml LB liquid medium at 37° C. for 1 hour and 0.2 ml of the cell suspension were plated on LB-agar plates supplemented with the antibiotics kanamycin 50 mg/L (Sigma). Plates were then incubated at 37° C. for 16 hours. Bacteria colonies were grown and expression was confirmed by PCR amplification using primers that were designed to span the inserted sequence in the binary vector. Primers used for DNA amplification of the inserts in the pGFP(-35S) binary vector were: 101F 5'-GCTATGACCAT-GATTACGCC-3': (forward, SEQ ID NO:869) and NOS_R: 5'-GCGGGACTCTAATCATAAAAACC-3' (reverse SEQ ID NO:895).

PCR products were separated on 1% agarose gels and product sizes were estimated by comparing to DNA ladder (MBI Fermentas). PCR products with the predicted size were sequenced using the same primers previously used for PCR amplification.

Sequencing of the inserted sequence was performed to verify that the clones were introduced in the right orientation, and to eliminate the possibility that sequence errors were included during PCR amplification. DNA sequences were determined using ABI 377 sequencer (Amersham Biosciences Inc).

CT2 promoter sequence, originated from the pGI+CT2 promoter (PCT Patent Appl. No. IL2005/000627 to the present inventors) was cloned by digesting the pGI+CT2 promoter vector with the restriction endonucleases HindIII and BamHI (Roche) and ligated into the binary constructs (pGFP(-35S)), digested with the same enzymes. Ligation products were introduced into E. coli cells and screen for positive colonies with primers: (forward 101F, SEQ ID NO:869) and (reverse GFP_R1, SEQ ID NO:896 5'-CACCT-TCACCCTCTCCACTG-3').

pCT vectors, harboring the tested genes [CT1, 2, 3, 6, 7, 9, 11, 20, 22, 27, 40, 71, 74, 75, 76, 81, 82, 84, 4, SEQ ID NOs. 874-892; disclosed in PCT Patent Appl. No IL2005/000627 to Evogene Ltd.)] were digested with the restriction endonuclease HindIII (Roche) and dephosphorylated with Alkaline Phosphatase (shrimp; Roche). The CT2 promoter::GFP was amplified using primer including HindIII restriction enzyme site. Primers used for PCR amplification were: CT2_pro_H: 5'-TTCAAGCTTTTTTTGTTTGTTGTGGGGG-3' (forward, SEQ ID NO:897) and NOS_ter_R_H: 5'-GGT-TAAGCTTCGACGGCCAGTGAATTCC-3' (reverse, SEQ ID NO:898).

The resultant PCR blunt ended products were purified using PCR Purification Kit (Qiagen, Germany) digested with HindIII (Roche) and cloned into each of the pCT dephosphorylation binary vectors (See FIG. 6 for an exemplary vector). Ligation products were introduced into E. coli cells and screen for positive colonies with primers: (forward b101F, SEQ ID NO:869) and 35S_R: 5'-GGACCACTGTCGGTA-GAGGC-3' (reverse, SEQ ID NO:899).

II. Cloning of the Selected Genes in a Binary Vector Under Constitutive Regulation and in Cis to CT2promoter::GUS Recombinant Expression:

Cloning the tested genes into the pGI+CT2-promoter expression vector—For cloning the tested genes under regulation of 35S promoter, primers for the 35Spromoter and NOS terminator were designed. Additional HindIII (Roche) restriction endonuclease sites were added to the 5' end of each primer to facilitate further cloning of the tested genes [CT1, 2, 3, 6, 7, 9, 11, 20, 22, 27, 40, 71, 74, 75, 76, 81, 82, 84, 4, SEQ ID NOs:874-892; (disclosed in PCT Patent Appl. No IL2005/000627 to Evogene Ltd.)], to the binary vector (pGI+CT2 promoter). Primers used for PCR amplification were: 5'-TTCTCTAAGCTTGCATGCCTGC-3' (forward, SEQ ID NO:900) and 5'-GGTTAAGCTTCGACGGCCAGTGAAT-TCC-3' (reverse, SEQ ID NO:901). Each of the above genes was cloned into the CT2 promoter GUS pGI+CT2-promoter (PCT Patent Appl. No. IL2005/000627). The CT2promoter::GUS plasmid were digested using the endonucleases HindIII (Roche) and dephosphorilation with Alkaline Phosphatase, shrimp (Roche).

Ligation products (see FIG. 7 for an exemplary vector) were introduced into E. coli cells and screen for positive colonies as describe previously.

Agrobacterium transformation of binary plasmids harboring the genes of interest and expression in cotton ovules—Each of the 38 binary constructs, comprising the 35S promoter upstream of each of the tested CTs genes and CT2 promoter::GFP or GUS was transformed into cotton developed ovules via Agrobacterium tumefacience transformation.

60 μl of Agrobacterium tumefaciens C58 competent cells (about 10⁹ cells/ml) were transformed with 20 ng of binary plasmid via electroporation, using a MicroPulser electroporator (BioRad), 0.2 cm cuvettes (BioRad) and EC-2 electroporation program (BioRad).

Agrobacterium cells were grown on 1 ml LB+50 mg/L of Carbenicillin+50 mg/L of Rifampicillin liquid medium at 28° C. for 3 hours and 0.08 ml of the cell suspension were plated on LB-agar plates supplemented with the antibiotics 50 mg/L of Carbenicillin+50 mg/L of Rifampicillin+50 mg/L of Kanamycin Plates were then incubated at 28° C. for 72 hours. Agrobacterium colonies were grown and PCR amplification was performed on Agrobacterium cells, using primers that were designed to span the inserted sequence in the binary vector. Primers used for PCR amplification were for GUS:

```
pGI(CT2 promoter) + CT20(35S promoter)
Forward, CT20_F_2
                                    (SEQ ID NO: 902)
5'-ACGGAGTCAACTCAGAATCG-3';
and
Reverse, CT2_pro_R_2
                                    (SEQ ID NO: 903)
5'-TGCATTATTCAAACCCTGTCTCC-3'.

pGI(CT2 promoter) + CT82(35S promoter)
Forward, CT82_RT_F
                                    (SEQ ID NO: 904)
5'-TCTCTAAGCGACGAAACGGGT-3';
and
                                    (SEQ ID NO: 903)
Reverse, CT2_pro_R_2.

(SEQ ID NO. 905)
pGI(CT2 promoter) + expansin (35S promoter)
                                    (SEQ ID NO: 899)
Forward, p35s_R
and
                                    (SEQ ID NO: 903)
Reverse, CT2_pro_R_2.

For the GFP construct:
                                    (SEQ ID NO: 869)
Forward 101F,
and
Reverse, GFP_R1
                                    (SEQ ID NO: 896)
5'-CACCTTCACCCTCTCCACTG-3'.
```

PCR products were separated on 1% agarose gels and product sizes were determined by comparing to DNA ladder (MBI Fermentas).

*Agrobacterium tumefaciens*-mediated transient assay for cotton balls—5 ml of *Agrobacterium* cultures (C58) were grown overnight from individual colonies at 28° C. in LB medium plus selective antibiotics. The next day the culture cells were recovered by centrifugation, resuspended in infiltration medium (10 mM $MgCl_2$, 10 mM MES, 200 µM acetosyringone, pH 5.6) to optical density=2, and incubated at room temperature with gentle agitation (20 rpm) for a minimum of 2 hours. Cultures were combined when required, collected with a syringe, and 300 µl were injected in the cotton balls by using a needle.

Agroinjection—Cotton balls (*Gossypium. hirsutum* cv Coker/DP&L90) at different stages of development 0, 2, 4 and 6 days post anthesis (DPA) were infiltrated (with the *agrobacteria* harboring the binary vector) using a 1-ml syringe with a 0.5-316-mm needle (BD Pastipak). Needle was introduced 1 to 2 mm in depth into the fruit tissue, and the infiltration solution was gently injected into the fruit. The total volume of solution injected varied with the size of the fruit, with a minimum of 0.1 ml and a maximum of 0.3 ml.

GUS staining of the cotton ovules—Leaves were fixed in 90% ice-cold acetone for 15-20 minutes (on ice), followed by removal of acetone, the tissue was rinsed with the Working Solution [25 mM Sodium Phosphate (Sigma, USA) buffer pH=7, Ferricyanide (Sigma, USA) 1.25 mM, Ferrocyanide (Sigma, USA) 1.25 mM, Triton X-100 (Sigma, USA) 0.25%, EDTA (BioLab, Israel) 0.25 mM] for 15-20 minutes (repeat twice). The rinse solution was removed, replaced with Staining solution [Working solution with 5-bromo-4-chloro-3-indolyl-β-D-glucuronic acid (X-GlcA, Duchefa) solubilized in N,N-Dimethylformamide (BioLab, Israel) 1.5 mg/ml and Dithiothreitol (DTT, Bio Lab) 100 mM] in dark (tubes wrapped with aluminum foil) and incubated over night at 37° C. Distaining was carried by sinking the plant tissue in 70% ethanol and heating at 50° C. for about 2 hours. Distaining step was repeated until the plant tissue became transparent except the blue stained regions. Distained plants were stored in 70% ethanol (BioLab, Israel) at room temperature.

Experimental Results

Detection of positive agroinjection using GUS—Validation of the agroinjection process was done using agroinjection of GUS under regulation of CT2 and 35S promoters at 1 and 8 DPA. After two days (3 and 10 DPA), the developed ball was picked and the ovules were GUS staining (FIGS. 4*a-c*).

Analysis of cotton developed fibers—First validation of the gene detection was done using agroinjection of 2 DPA ovules with two constructs: 35S::CT20, CT2pro::GFP; 35S:: expansin, CT2pro::GFP; After two days (4 DPA), the developed ball was picked and the ovules were screened for fiber analysis. In order to detect the developed fiber length, the present inventors have made a widthwise slice of about 0.2 mm. The slices were screened for GFP expression under UV light using 10× microscope lens. Positive GFP were points on positive infiltration. The developed fiber length of the positive GFP ovules was determined (in micron) using lens scale. In order to measure the effect of each of the selected gene on the fiber development, three different agroinjection flowers were used; in each flower three different ovules were measured. The fiber length measurements are summarized in Table 13, hereinbelow. From the results it is possible to see that expansin (FIG. 5*c*) and CT20 (FIG. 5*b*) exhibited an elongation effect on 4 DPA developed fiber as compared to control (FIG. 5*a*). Quantitation of such an elongation effect is depicted in Table 13, hereinbelow.

TABLE 13

Influence of overexpression of new genes in 4 DPA developed fiber on fiber length

| Construct | Fiber length |
|---|---|
| 35S:: expansin, CT2pro::GFP | 12.5 |
| 35S::CT20, CT2pro::GFP | 11.8 |
| CT2pro::GFP | 10.6 |

Using agroinjection the present inventors have demonstrated the influence of cotton genes on fiber development, and the detection of expression of reporter genes under the transcriptional control of cotton fiber promoters. Previous studies have shown that transgenic cotton lines overexpressing Expansin produce fiber of increased length (US Pat. Application No. US20040006794). This study shows that agroinjection of expansin in 4 DPA developed fiber results with an enlarged fiber length as compared to control. Elongation of the 4 DPA developed fiber was also observed by overexpression of CT20 (SEQ ID NO:881). In previous studies, the present inventors have demonstrated the possibility to use tomato seed hair as model for cotton fiber and showed that CT20 significantly elongated tomato seed hair compare to wild type (0.366±0.006 mm compare to 0.319±0.008) (PCT Patent Appl. No. IL2005/000627 to the present inventors). In this study the present inventors show, for the first time, that expression of fiber developing genes such as CT20 and expasin to an already developed fibers (e.g., 2, 4 or 8 DPA) can significantly elongate cotton fibers.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the invention. To the extent that section headings are used, they should not be construed as necessarily limiting.

CD-ROM Content

The following lists the file content of the enclosed CD-ROM. File information is provided as: File name/byte size/date of creation/machine format/operating system.

CD-ROM (1 File):

1. 46366 Sequence Listing/1,540,096 bytes/May 14, 2009/Notepad/PC.

REFERENCES

Additional References Cited in Text

Clough S. J, and Bent A. F (1998). Floral dip: a simplified method for *Agrobacterium*-mediated transformation of *Arabidopsis thaliana*. Plant J. 16, 735-43.

Curtis I. S, Davey M. R, and Power J. B. 1995. Leaf disk transformation. Methods Mol. Biol. 44, 59-70.

Desfeux C, Clough S. J, and Bent A. F (2000). Female reproductive tissues are the primary target of *Agrobacterium*-mediated transformation by the *Arabidopsis* floral-dip method. Plant Physiol. 123, 895-904.

Goodin M M, Dietzgen R G, Schichnes D, Ruzin S, Jackson A O. pGD vectors: versatile tools for the expression of green and red fluorescent protein fusions in agroinfiltrated plant leaves. Plant J. 2002 August; 31(3):375-83.

Jefferson R A, Kavanagh T A, Bevan M W. GUS fusions: beta-glucuronidase as a sensitive and versatile gene fusion marker in higher plants. EMBO J. 1987 December Kapila et al. 1997 Kapila J., de Rycke R., van Montagu M. und Angenon G. (1977): "An "*Agrobacterium*"-mediated transient gene expression system for intact leaves. "Plant Science 122, 101-108.

Kim H. J, and Triplett B. A. 2001. Cotton fiber growth in planta and in vitro. Models for plant cell elongation and cell wall biogenesis. Plant Physiol. 2001 December; 127 (4): 1361-6.

Meissner R, Chague V, Zhu Q, Emmanuel E, Elkind Y, Levy A. A. 2000. Technical advance: a high throughput system for transposon tagging and promoter trapping in tomato. Plant J. 22, 265-74.

Orzaez D., Mirabel S., Wieland W H., Granell A. 2006; Plant Physiology, 140: 3-11.

Ruan Y. L, Llewellyn D. J, and Furbank R. T. 2003. Supression of Sucrose Synthase gene expression represses cotton fiber cell initiation, elongation and seed development. Plant Cell 15, 952-964.

Wagner. G. J, Wang. E and Shepherd. R. W. 2004. New approaches for studying and exploiting an old protuberance, the plant trichome. Ann. Bot. 93, 3-11.

Wang E, Gan S, and Wagner G. J. 2002. Isolation and characterization of the CYP71D16 trichome-specific promoter from *Nicotiana tabacum* L. J Exp Bot. 53(376): 1891-7.

Yang Y, Li R, Qi M. In vivo analysis of plant promoters and transcription factors by agroinfiltration of tobacco leaves. Plant J. 2000 June; 22(6):543-51.

SEQUENCE LISTING (939 sequences)

SEQ ID NO: 1 - DNA, 1729 bp, Gossypium hirsutum
  misc_feature (1688)..(1688): n is a, c, g, or t
  misc_feature (1690)..(1690): n is a, c, g, or t
tcggaataacagtttgctcaccaaggaaacatgagccacctcgatgcctaaattacttgacttcacctcatgttgtcatatggagtgccgtaagcgcttcttgtgcttttcctggcctttttgaagctcaggaactaatggcgaaagataggagtggggaactcgttccttaccatcctccctttaatttggatcccgaggagggttctagtgcaactgctcgtcgatggagggatggtagcttggaggtcgatttacctatgatgcaacttaaggagctgttcaatgtcaatcatttcattgtgagtcaagcaaaccctcatatcataccatttttgagggtaaaggagtttgttcgagcccatggtggtaactttgcggcaaagtttgcgcacctaaccgagatggaagttaaacatagatgtagccaaatacttgaactgggatttcgtatggggggactagccaagatatttgctcaagattgggagggtgatattaccgttgttatgccagccacagtttctcagtacttgaaaattctacaaaacccaactcttgtggagcttcaaaaggcagccaaccaagggagaagatgcacttgggagaagctgtcggctatgaaagcaaattgcggcatcgagcttgccctcgatgagtgtgttgcaattcttaaccacatgcgtaggcttaaacggagtgccgacagagctgctgccgcttcatctcatggtcttgccaacacaaccaaattcagtgcttcgaagagaatcccgtcttggaattgcattgcaagagaaaactcatcaggctccctcgaagaagaccttctcacagatgttacttcgtctttgcatcacggagtaggcagttcttcgggaataccaccacctgctaggaatttacgagcccatcgcagtgcctatgatggaagtgatagtgaatcagaaggtgtagacttacattcttggacaagatctggtggtccgttgatgaggacgagttccgcaaatctgttcattgactttgtccaaaatctagacgctgaagctgaagtgaacaaaggtctaatggctcatcctagttctcctggatttcagatatgcggcggggattcttttagtcacagcccgaggatgatgaaatcagatagaggttcagaatacgagtttgatcaaagggatttcgggaacagaccgcctgttaacggttctagcattatggtcactgaaggtgatctcttacaacctgaaaaggtcattaatggacttatgctcaacgtggtgaagaaagctgacttggcacagtcaagtcgaagccctgattcagataattgtagtactgaagtagctgaatgtgtgcagctggagtgtccagagaaggacgatagctccgcatctgaatgtggcgacgatgatgccggtgcagtaaatgagacggttgcaaccgataatttgacccgaagtgctcgtgatgatgataatcagggtggtgttgtagatgcctaagtttttaagattaacctaatgacccaaatttttgggtggcaacaaattggtccctgctttaaaaaagggtattcattgctagtaaaaaatttaccatgattgattaaatttttttatttactatttgtaattttttgtatgacataaatattatcactatttgtttcttttactttggtncnacaaaacacaacacccctccaaacaaccaaaacaactct

SEQ ID NO: 2 - DNA, 1578 bp, Gossypium hirsutum
ctcgtgccgaagaaatagttttttctttyttggggggtggggtccctaagatgacaaaccaagaaaactcagtgattgttgtgatggtgccatttccagcacagggtcatttaaaccagttgcttcacctctctaggatcatcctctcctatggcatcccggttcattatgttggtacatccacacacaaccggcaggcaaaggtcagagttcatggttgggatcctgtagctgtggctagtttccatttccatgactgtcaagttcctccttttgcttctcctcctccaaaccccaatgcagcaatcaaattcccttctcatctccagccatgttttgatgcctgtcatcatcttcgtaaacctgtcactgagttgttacgcatgctttctttacaagcaaaaaaggtcgttatcattcatgactctatgatgggatccgtggttcaagatgttggttcaattcccagcacagaatcctatgctttccacactgtttctgccttttctctcttcttttatttatgggaatcagcggggaaaccacaagttaacgcagaaatgcttggtgaaaatgacgttccttctcttgaaggatgcttcactgaagattwcttggagttcattgctttgcaacaccgatatctaaacgtcacttctgggagtatatataacacaagcgaagtgatagaaggtacatacgttgagttgcttcgccaacatatgaaagaaaagcaccattgggctttggggccatttaatccattaaaagtacctgagaaaaacagttgcggtagccgacactactgtttggaatggcttgataaacaggrgatgaactctgttctttacgtgtcttttgggactacaaccacaatgggtgatgaacaaatccaagaactggcaattggtttgagacgaagcaatcaaaagttcatttgggtattgagagatgctgacacaggtgatgttttcaatggagaagttagaaggccggagcttccaatgggataccaagattcagtgaaagataaagggttggtggtgagagattgggcacctcagctggagatattagcccaccctgccattggtgggtttgtaagccactgtgggtggaattcatgcatggaaagcatcaccatgggagtaccaataggggcttggcctgtgcattcagatcaaccaagaaacgcagtactaatcacaaagttgctcaaactcggcattaccatcaaggactgggcacgtcgagatgaagtagtgacagcagcggtagttgaagatgccgtgaaacgtttgatggcttcagaggaaggagatgagataaggaagagagcggcagaagtaagtggtgcggtgcgccaatcgttggctgaaggtgaggtttaccgtaaggagtgggactccttcattactcatatcattaggtaggttttatcatttattattatcaaactactgccacatgattattttccttcaagtatgtgttaatctacgaaacaaatttcggaaaatgaaaattatgaaataaaatttaatgtttcttttttaagtgaaatgacattctatacta

SEQ ID NO: 3 - DNA, 1051 bp, Gossypium hirsutum
atttttctacaaaaggccacaaatcccaaaatcaccgcaagttccatcaaaaccccgccaattacgcaccttgtccgtcgcctaccatttttatacactccccctgctttaaagttaaatcccatttcacacatctcagacaagaaatacaaatacccattttcaccaccatcaaaccacatcccacagacatgggtgcccacgaagaagaagccggaggtgaagagtacttgtttaagatcgtgctgatcggtgactcagctgtgggaaaatcgaaccttttgtcacgttttgctaggaacgagttcgacaataactcaaaggcaactattggagtagagttccaaacgcaatgcgtggaaattgatgggaaagaagttaaagcacagatctgggacactgctggtcaagaaaggtttcgagctgttacttctgcttactatagaggagctgttggtgctcttattgtttatgatattactaggaggagtagctttgacagcattaaacgttggcttgatgaacttaccactcattgtgatactacattgacaagaatgctggtggggaacaaatgtgatttggagaacataagagatgtaagtgtggaggaaggcaaaagcctcgcagaggaagaaggcttgttcttcctggaaacgtctgccctcgaatctactaacgttcagactgctttcgagatcgttatccgggaaatctacaacaatgtaagccgaaaagccctaaactctgattcatataaaggtgagttgtctgggaataaagtcaccctagtcaaggatggggcaaatgcttccaagacgggtttctcctgctgtgccagatgatctctggtcctccatattgcagagaagccacctgtttccactcttctaatcctggtgtgtcaattttggagctttctcaattttattttttttaaggtttgttatagttaaaaaataagactgcagttatgttcctatatatatactcttttacaagccaaaagatttccatgaagtagacccaggttgcccagacattgatgaca

SEQ ID NO: 4 - DNA, 1576 bp, Gossypium hirsutum
  misc_feature (29)..(30): n is a, c, g, or t
  misc_feature (74)..(74): n is a, c, g, or t
gttaaatgtttcaaccaacacaaaccacnncccgtctgaggggcctatttaagaatttgaagtacgggccatgngaagagtaacatccattccggagaatagaatttctaataaaggaccggattccctttccaagcttcagcaagccagatatggctcaaaatatggccaggagaagggttgttttggtgcagattttggcactagccttggccgctgttatgccattgctctcaggaggtgtggatattcaacaagttagggtgctggcagctaaattcaacgtgacttgcgtagtggtattcggagactccagcgtggatccaggcaataacaactatattgctacgccctttaagggtaatttcctaccgtatgggaaagacttcttcagaggccacccgactggacggttcagcaatggaaggctagccactgattttattgctgaagctttgggttacacgaacgaaattcgacctttccttaacaagagattgagaccagttgatatcttgcatggtgttagtttcgcatcagctgcttctggttatgatgagctcactgccaatctctcacatgtcctgccggtttccaagcagctagagtatttcagggaatataagatgcggctgaggcaactggttggagcgaggaaagcagaaaatattataaaaaatgcggtagctgtgatgagtatgggcacaaatgactttcttcaaaactactatttagaacccattcgccccaagcagtatactttggaagagtaccaaaattacttggcttcttgcatgtctgacgatgttaagacgatgcacagtcttgggataacaagattagtggtagttggggtgcctcccctggggtgcatgccccttgtcaagactctaatgaaccaggaaacatgtgtggaaaagtataacaatttctcctcctccttcaattccaagctacaattcaagttggaagtcgccaggacaacattagggatgaaaattggctacgttgatgcttatggcatctttgaggacgctgtcaataactccaaaaaatatggtttcattgaagcttcaaaagggtgttgcgggacggggaccatagagtatggagatacatgcagaggcatgagtacatgcgctgatgcgtcaaaatatgtattctgggatgctgttcatcccactgaaagaatgtatgaaataatcgctgggcaggccattgattctctccggaaacagctgatggcctagctagaagcctgcaagctgcaactttaggtagatcggtgcgttaattaagtatgctttgtactaagactctacgactaaaagaaactgttttgtgtaatttagcattttggcttctcctattgtttgtttatcaatctgtctaccatttttgaggtacgcttgttggatggaaaagtgaaaggtggaaggaaggactgaaaaagtagaaaataaataattggagtatgcttatttttcttttttttttttggagaaaacattatgaatgctcactattggtcaataatatacacacttatgtttggaatacaaaaataaaaaaactt

SEQ ID NO: 5 - DNA, 1815 bp, Gossypium hirsutum
gatcttaccaagtatagcttttttcttttgcctttttgtcatttcccttaattaattgtctcttatggagttgttctcttttttgttgataatttcaattttctatcttctcttcaaaatatggaattggatcaataacgtgagagaccaacaatgttacattttggattaccaatgctacaagcccagtgatgataggatggtggggactgagttctgcggggaagtgataaagaggaacaagaatctcggactcaacgagtacaagttcttgctgaaagccattgtcagttcaggcatcggagaacaaacctacgccccgaggatcatgttttccgggagagaagagagcccgaaactggaagatgggatcttggaaatggaagagttttttcacgatagcatcgagaaggtgttatcaagggcaggcatatctcctcaagaaatcgatctcttattcgtcaatgtctccatgttatccacagttccttctttgtgttctcggatcataaaccactacaaaatgagaccagacatcaagtcttttaacttaactggaatggggtgtagtgctagtctgatttctcttgacattgttcgcaatgtcttcaagtcttacaagaacaagttcgcattgcttgtgacttcggaatcgttgagtccgaattggtatgctggcaacgatagatcgatgattctctccaattgtttgttccgttcgggtggctgcgcagtacttttgacaaacaacaagtccttgaagcatcgagcaatgttcaaattgaaatgcttggtgagaacacatcatggagccaaagatgagtcgtatggttgttgtatccaaagggaagatgataaaggaaggatgggatttcaccttagcaaaagccttcccaaagccgcaactcgttctttcgtcgataatttgagggtcatcaccccaaagatcctgcctgttagggaactattccggttcatggcagtttcactccttaaaaaatggaacgtcgtccgccatggttcttcccacaagggagcttctcaaggaccaatcaaagctggggtgaacttcaagagtggggtggaccatttctgcatccacacaggagggaaagcagtgatagatgggatcggaataagccttgatttgaccgagtatgatttggagccagctaggatgacactgcatcgatttggcaacacatcggcaagtagcctgtggtatgttttggcatacatggaagccaaaaagaggctgaagaaaggggataaggtgttgatgataagctttggtgctggctttaaatgcaacagttgtttgtgggaggttgtaagggatttaggagatgggaatgtatggaaagatgaaatttacatgtacccaccaaagacattggttaatccttacatggaaaagtttggctggattcaagatgaagatcctagcaccttcaatcctggagattaaaagtctattaaggtaaaaataaaatatctaaatttgatcattgtatttctttgtatacagtcaagttcttaagattgttaaatcccaaagtggattcataaacaataagttgggcagctttcggtgatgagaagtgtgcctttttttttttattaataattggtaatccttaatttattgttgaatttcgagggaaattaaaaaggaatcaggtttatagttgaagagattttcaaatcaatgctcttgtttttcgagggaataagttgttaacatttaaacaaatcacacaaatcttgacctaatttcaatcaagagttgaaatgaacgaaaatattttgtccttg

SEQ ID NO: 6 - DNA, 1418 bp, Gossypium hirsutum
gaagaaaacgatggaggatcttgccgtcgataagattgtcaatattggtatcggattagtgccgccggagatggctgatcaactttatgaaggaattcattctcatttggaaaatgttggaattgacggagttaaagttgacgtgattcatctgttggaaatgctgtgtgaaaactatggtggaagagttgatcttgcaaaagcttattataaagctttaacagattcagttaaaaagcatttcaaaggcaatggtgttattgccagtatggaacactgcaacgatttcatgtttcttggaacagaagccatttgtcttggtcgtgtckgggacgatttttggtgcactgatccatcaggtgaccctaatgggacattttggctccaaggttgtcacatggtgcactgtgcttacaacagtttatggatgggcaactttatccaccctgattgggacatgttccagtcctcccacccttgtgctgagttccacgctgcttcaagggccatctccggtggcccaatttacatcagcgacactgttggcaaccacaactttgctctcctcaaacgcctcgttttacccgatggttcgatcctccgctgccaatactacgctcttccaaccagggattgcctatttgaggaccctctccatgatggcaaaaccatgctcaaaatctggaacttgaataagtatactggtgtgattggcgcatttaactgccaaggaggcggatggtgccgagaaactagaagaaaccaatgcttttccgagttttcgcatacggtaaaggccgagatgaatccaaagaacattgagtggaacagtggaaagaacccaatttccattgaagatgtccaagtattcgccatgtatttttctcagtccaagaaactagtcctctcaaaaccggctgaaaacatggaaatctcgctgaaaccattcgatttcgagcttataaccgtatcgccggtcactgtgtttggtagaaaatcagtccaattcgcccctattggactagtgaacatgctgaatgccggtggtgccatccagtcattagcctacaatgaaagctcagttcgaattgaattgaagggagccggtgaaatgagagcctttgcttcgaacaagccgacagcttgcaaaattgatgggaaagatgttgggtttgagttcgagaacaacatggtcattgttcatgttccatggccagctccttctggtttatccacattagagtatctgttttaagttactgacttattgacttcgtagaataactctgtaatgacatttcaattccaaatgagtgaaaacttttaagactacgtaagaattgaagttaattggattataatatacaggggagctatctcacagagagacactctatctttatagaccgccccccccc

SEQ ID NO: 7 - DNA, 1062 bp, Gossypium hirsutum
ggagaggcataactacatgacaggatctggttccagcctagagtaagacccacctccccatgtgatctctttccttttattacccaccatcaacgttccaatttcatatcactcttcattcctcacctactctctgcaaaaatggcaaggaaaattgtgctcattctggtactgagatgcctctgcattgggctagcagctgctgactggaacatcttgaacccaatatggaatatcaatgcaagacaagatagcttgaaaaactactgtgaaagttggaggatcaatgtggagctgaacaacataagggagttcgatgtagtgccccaagaatgcgttgctcacatcaagaagtacatgacttcatcacagtacgatgctgactgccagagagctatcgaggaagtgacactatacttaagccgctgttgctctttgaaaggtgatggcaaagatgcatggattttcgatgttgatgatacactcatctccaccattccttacttcaagaaacatggttttgggggagagaaggtgaactcatcttctttggaggcatggatggaagagagcaaggcaccagctctcgaccacacattcaagctcttccatgacattaaagatagagggatgaaaatctttctagtctcttcaaggaaagaaacccttagatctcctaccgttgataacctcattaatgttggataccatggatggtctaggctcttcttaaggggtttcgaagatgaatacatgcatgtggaacaatacaagtcccaagtgaggaaaacattaatggatcaagggtaccgcatatggggaatcgttggagatcaatggagcagcttaaagggtttgccagaagcaaagagaacattcaagctgccaaattccatttactacatgtcttaacttcatctgaataaatttttatgcactcattttcccacctcatgtgcttttgtatttgcttgcggttgttttcagaaatccaatataaaatatcagtaaaaatatctatatttatcttctaaaagaaaaaataaaaactgccaaaatcaa

SEQ ID NO: 8 - DNA, 882 bp, Gossypium hirsutum
gcaatgcaaagcacaaaacttgaactcttcaagaccattcgacaatggtgacaatccctttctttgtcctaatcatcctccttttcctctccagctccgcggccacaccaaagagcggtgcaggtcacgacctggtccgttcatcatgtgtccacgccagctatccaagcctctgttttcgcaccctttcttcctactccggcccagccaacaccccacgtgagttagcccaagccgccgtaaaagtcagcctgtcccgtgcccggaaagtgtcgaactacttgtcgacgagtgtgacggggtacaacaagagggaacgagtcgcactgagtgactgcgtggagcaaatagatgagtcgatggaggagttgagcaagacactaggggagttgaagcacttgagaggggagacgttcgagtttcagatgagtaatgcgcagacatgggtgagtgcggcgctgacgaatgaggacacgtgtcttgatgggttcgaaggagttgacggcaaggttaaatctgatgtgaagaggaagatcacgaatgtggctaaagttaccagtaatgctctgtacatgatcaataggctcaatgaaagtcgtggtaggcaccgttgaatctttgatgatgatgaataatggatggttgtgatttatctagcttattatgttttttaaatatagtttttattttggttttggttgcaacctgtatatgtaatgttttctatttatatattaaacataaggtgatctcgcttctagtggctcaaacattctacacctctggcagataattctcaaccggccgcggccctttctatttctccacccgggggggcgcctccgcttaccgttcccttatctcccccatatgacaagtacg

SEQ ID NO: 9 - DNA, 1547 bp, Gossypium hirsutum
catgcctgctttactaaaagctgagaaggaacggagaatgggaaaaagtgaatactactccaacaaccgacgtttaggtagaagttagatttgtttgacatcgaggtttgttttcgtctcattatttccatcttaatttgctgtctttagtgttcaagtttcagcgttcgaatccatgattttttccatcttcaaaagccaagtcttcattagaaatggctctgtcattctcccaacctgtgctaaaaatgtgagtttttctcgaccaattgcattgctacttgttagatatgaatctggaattgcagaaaatgaacagccgtttaagatttcttacctcataaacacaatcgggttgtctccacagtctgctttwtcagtgtctaagaagctccattttgagacctctcaacaaccagacactgtgatttccttcytcaacaaccatggsttttcaagaacccagattagagacatcgttcagaaatggcctgcatctcttttatgcaaccctgagaaaacccttttgcccaaacttcaattcttttactccaaaaggatttcaggttctcaacttwtaagaatcttgtcttcaaacccagatgcctttagacgtagtttagataattgcrtcatcccaaacttcaactccttcaaggaattcactcgatgtggygacgatcaggtgtttttagcatacaagaactattccgacgtcctttcacgtaattttcaatccattgttgctcctaatattgcaatcctgaaagaatatggggtgcctgaatcaaatattatggttgaacttgttgtccacccaagagcctatgcagtgagtcctgataagtttagtagaacagttgaacaagtaaagaaaatgggatttaatccttcaaaacgtaggttccttacagctcttcaagctttcttacagactagcaaatcaacatgggaaaagaaattcgatcttcttarccaatggggttggtctaatgaagttgttctttcagcttttgagaagtatccgagattcatgatgttttctgagaagaagatcactacaataakgractttttcgtccacacaatgggatggaaatcattggatattgctaaccgtccggttattctttcgtatagcttggagaggagaattatcccaaggtgttcggttcttcaagccttgttatccaaaggtttgatcaagaaattcagtgtatgtcttgttctggagtatactgaaaaggcattcctccaaaggttcatcaccccttatgaagatccttatatattgaaattatatgagcagaagttaggcctttcagaataaatagtataattctatagttacccaagacggatatgggtatgtatcagacatgggtatgtttagtgttttaagattttgcatgtcaatgtgtcaggcacagagtaccataagaaaaaatgaagagttcatccaacatgggtatgatttagatgctaaaactgaactaatgtgcatttgcctgtgattgtttgaatgaaggttgagtttgtttccttga

SEQ ID NO: 10 - DNA, 1000 bp, Gossypium hirsutum
gggattcataattaaaatcccaattttattttcmatwtccggtaaaagaatccgacccggtaacccgacatggcmtyctatagagtggatgacgactacgattatttgtttaaggtggtgttggtcggagattccggcgtcgggaaatcgaatttgttgtcgagatttactagaaacgagtttagccttcaatctaaatccacaatcggtgtcgaatttgccacccgaagtattcgggtcaatgataaaatcgttaaggcccagatttgggacactgctggacaagaaagataccgggcaattacaagtgcatactaccgaggagctgttggtgccttgcttgtctatgatgtcactcgacgggtcacgtttgagaatgttcagagatggctgaaggaactacgagatcatacagattctagcatcgtgattatgctcattggtaacaaggccgacctgcgacacttgtttgccgttaccactgacgatgctaaggcctatgccgagagtgaaaacaccttctttatggaaacatctgccctcgaatcaacaaatgttgagcatgcattcactgaagtactaactaaaatacatcatgtgatcagtcgaaaagcgctcgaaggagggaatgatcaaacaacattgcccaagggacaaaccatcaatgtcggatctcgggatgatgtttcagctgtgaagaaagacggctgctgttctgcataattgttagatgattccgagtgtccaaatttacttcctcatttagcataagctttcctcaccgtgatctttttcgagatctttcgttgaagaygaagaaatcrcagcattccagggatttccttcattcattcgatttcagttcctttttcatggttctttagggtatttttcttcttcatgtaatgttccattccatagtttttgttgtatttgattgctttagaatacatagtttgttcagacagatctagttttagtattttaaatgattttcatt

SEQ ID NO: 11 - DNA, 1202 bp, Gossypium hirsutum
taatcttattgttcataattccaaataataataatattttattctaaaaatagtatataaggaattaatgtataaatattaaataaatctcataaaaataatatcttaccaaataaatgaatgaatttacctaataaagaaaaatacaaattcatcgaaagggttctagcattgaaaaaaaaaacttacttaagctaaaactagcagctgctttctatcagatttttcttttctgttctttagaaaaaagatctattaatttgaaaaaaaaaacatggaaggagacgatgtagacatggcagctgctgaatccactgaagcagatcttgatgacatgaagaaaaggttaaaagagatggaggaagaagccgctgctcttcgtgagatgcaagctaaagtcgagaaagagatgggttccgtacaagatcctgctgctgctgcagctacatctcaggcaaatcgagaggaagtggattctcgatcagtgtttgtgggcaatgtggattattcatgtactcctgaagaagttcaacagcatttccagacttgtgggactgtaaatagggttactattcgtacggacaagtatggtcagccaaagggttatgcttatgtagagttcgttgaagctgaggctgtccaggaagctcttcttttgaatgaatctgaacttcatggcaggcaattgaaggtcactgctaagcggaccaatatacctgggatgaaacaatatcgtccacgtcggtccaacccttttatgcgacccaggggtccattcatggctccatatttctttgctccatatggatatgggaaggttccacggttgagaatggcaacgcgttacagcccctattattaggtacttggattgaactggttgttctgaatgcttttcctatccgcatctctgaggttcgttgtatcgaattgaagtcgatttgccaaagctatggtacaaaattggcggtctactttgattgatggtgaactactttagtatgtttcttctgtgttgtctgatgatgtagacatgttttgagtaatgttgagctgccctttgtgctttttcctcaagaaacttcttgttggtacttgtttcttaagaattgaatcatcagccttttagacttatgtttaaaaccccaagtccaatttaggatgcatatgggttccattttgaattatttttaaaaaaaaag

SEQ ID NO: 12 - DNA, 801 bp, Gossypium hirsutum
gggcacaatatttctgaggatacatggcagcaagttttagcttttagttggtgtgtgcatgaaaccctagaagggtatgatcctgaaggtgcttggcccgttttaatcgatgactttgttgagcatatgtacagaatttcggggtcgaataaagatacaaatggtttctgtagctatggtgattcagggtcccagttgtgtgcatacgatgactctttgcccggactaaaactagttccggggttgaagaggaagttgcgtgaatgtaacaatgataaaatggagtccttggaaccattattctcgagctctccgaacccgaattgcacatcaaattccaagagaaggtttattttgtgcagatctgatgagagggaagataatcttccccagaattcatgcgatgagagcatggaaattgttaaacaaagtagtccggtgggttcttccaagtctccatgtgcagttgaaggttgcatgtcaaagggtttagcagggctgttatcttgttgctcgtattttgcagtttgattgggaaagaggagttttgctataggtagaagctccctatgtaggggaaaagaaaatggatacatgctttactacaagtctatgaattagataaattcatatgttagcttgtggggggagggttataaacagagtgcctacattttcggatgactgtgtggggttgatttcctttttttcaatgtttgaggggtgctaatatcattggtttgtggatgttttgatcctgaaattaataattaaaatttttgaaaattttagttaaaaaaa

SEQ ID NO: 13 - DNA, 803 bp, Gossypium hirsutum
  misc_feature (63)..(63): n is a, c, g, or t
agaatccccaatcgacaatatcatcttcccaagtattttttatccatgtttgctgcggactanccttggtcgctgggttttgggtggcccaccatgtctattccctcaatctcgtctttgatcctacaaaaactctttgtttgatctgggctattgaattcccagttgttatccttcttttcagttgctgtagacagaaaccggagaaatgctcgtatttcacagctattgcccgaggtctgctgggacttcctattggggctctattaaatgcgcttggagcattagctttgggtgcacccgtcggcttgcaatacttaaaaaagacagttaactggtctcttctgatgtcttcattcacttttgtgcccacagcttgtgtttatggttcaagttggacagattggtgtcgcatatttgcatgtacaaagccaaatggacctttggaatttatgctttgtctaccagcacatggagctgtaattggagcttggtttggtgcttggcctatgccacttgattgggaacgcccttggcaggattggccaatctgtgtgagttatggagcaatggctggttacgtggttgggatggtgggatcctttggtcttgcactaataatgcatactggacgaaagcaactcaaagcaaagtagatggtactctttttccgtttcagtgaagcaatgactggtatagttgttttgtccgattttgcgattatatatatatattctctttaagttgctgaaaaatatactaaatcagtttattctttattggataatatcaatttaaccaga

SEQ ID NO: 14 - DNA, 811 bp, Gossypium hirsutum
cacagagataaaaagaggggcatttcaatcaccgtgatggcggcggcggctcatatagatatagagccagcaatacccgaagaagaaacgacgtcgaattcccttatacgaaacactcgttgctgcttctgtttcccttgcttcagctcccgtcgtacgcctgccgttggcgtagccttttggcagcggataggttcgtcccacgtccagtccgatactggcttctggtcctcaagtgttagagccttcaagaaggttcgagagtggtccgagatcgtcgccggcccccgctggaagacttttatcaggagattcaaccgtagcaaaagtgggggcggaatcgtctccggcggtaggcatggacaattccattatgatcctttgagttacgctttgaatttcgacgaaggcccgcgacagaatggtaatttggaagacgataatgatttcggtgcctttcgggctttctcaacccgttacgcttctgttcccggttcggagaaaacaccattggcgtagatgacgccgaatggatcatgtacagtgaaccggtgacgtcactacggcgtggcttcttcgtttacttttatatgataagatggcacattgtagggttatttttgcttaatggataggtgggtgggttggggtgatagtgaaaggtgaggatgaagcgtatgggattaagattagattttgtatgtattcatttttgggctttttctgattttggagcttttaagttattttgcgtttaattttcctaattatgtaaatataaaataggtttatatctcaaaaattccttccc

SEQ ID NO: 15 - DNA, 1335 bp, Gossypium hirsutum
gtttcttcttggtgttttagggtttatagaggagggygggagagacacacaaagcgagaagggttagaatgggaaaccagaaacaaaagtggacvgcggaggaagaggaggcgcttctggccggaatcaccaaacacggtcctggaaagtggaagaacatccttaaagatcccgaatttgcccctttcctcactcaccgctccaacattgacctcaaggataaatggcggaatttgagtgtyagtacttctactcaaggtgccagagacaaatcaagagcacccaaggtaaaagccattgttgcttcccttcccaacactcccaattcttctgctccagttgcgtygcgtgctcacaatgtaacttctgatactgttgtgggtgattcttcaaacaacggyatagacgggaagaatgctcctaggtataacacaatgatttttgaagccctttcaaccattaaagatacaaatggatgtgatataagtgcaattgtaagctacattgagcaaaggcatgaagttccaccaaattttagaaggttactaagttcaaggctgagaagacttgtttcacaaggcaaactggaaaaggtacaaaattgctacaagattagagaagataccttgatgggaacagaaacacctacccctaaacaaaaagacgtacgcctgcggcagaattctgatgcaataggttctggtgaaacagtagaagaagcagccatcacaacagcctataaagttgctgaagctgaaaataaatcgtttttagccgctgaggccgtgaaggaggcagaaagagtctccaaaatggctgaagataccgattcaatgcttcagctagtgaaagaaatctatgaacaatgttcacgaggggaaactgttattttggtttgagtctttagctgcctaggatgtaagtgatagttgtctttttctttataaattttggaatctgtgtatgtatgtgaattgtggatccattgatcttgttcaatgaatcaatgcatgggcattgaaatgcatttatgaccattcaaagatccatgatgaatcatgtagttagtatattacaaggtattattgtacaattagcccgttataattagagtggaaaccagttttgacttttggaagcaacatgtagacaaggggaatgtacattttagaatcataataatgaagaaactcttttagccccatcccatggcattagtgacgaaaagcctacatttctatggatactaggggatgggatctatgatatttgggcggaatgttgggtatgcgtatgtgtatggtattggggtatatatatttcaaagttattttt

SEQ ID NO: 16 - DNA, 524 bp, Gossypium hirsutum
ggcttctcctcctttaagtttgaatattaaaaaaataatcagtgtgtgtgtgtgtgtgttttttttttttctttggtctggcttgaaaatggtgtgcttttgtttcctagtggaccaaaggcatatgctgatgagcagcaagccggcagccgggacatgcttgcggtgccgcagcggagcaagtgtcgggctcatgaaaacggttacccgtttttgttatgtcccaatttattggaaatcttggaaggctataatctgcacattttgtggagctgttcttaaatcttacagatgatgaagttcaatgctttctatttgtgtttcaagttagttaattaggtttttgttttttagatatataaaaaaaagggaaatgtttgttttgatacacacaaatttctctttttaaaaaaaatttaaaatcggattaacatgtaactcatggaatatatatatatatatatatatacatgtataatatgtattactttcgttgattgttattaaaatattatcaaaaagtt

SEQ ID NO: 17 - DNA, 778 bp, Gossypium hirsutum
acacaacataacgtgctaagagtcccttcaccgtcctttatttttccaactaaaattaggctttaaactttaaaacattatgggtttagcagcagccctcctcttcctcctcctagcagctccggcggcttttgccgagcaatacaccgtaggagacagcagcggttggaccacgaccggagattaccaaagttgggttcaagggaaaacattcaccgtaggcgacacacttttgtttacctacggtggcagccactcggtggaggaagtatccaagagcgactacgataattgcaacaccggcaatgctattaaatcctacagcgatgggaacactgtcatcacactgtccaacccaggggcaatgtatttcatatgccccaccataggtcactgtgctggtggcatgaagctagccatcaatgttgtagcagctagtggcaactcaccctccaccccctctactccgtctggttccaccactccttccgggactcccccgagtggtggtacaacaacttctcccccgtcaacacctagcggagctccgagcaccgtgaattatggttttatggtagccttgttgggagccgttgttggaattatgtgctaggggagaggcagtgctattgtttattggcttatttgctttcgttttcgtcaatattcggtgtgattttattttatttttcctttatgaaccagagatggagagttatgtttttatgatcttcgaaataatttgccttaaattatgattaaaaaacaggtcttttac

SEQ ID NO: 18 - DNA, 1822 bp, Gossypium hirsutum
atacatatatgtaacatcttcaatctttgtttccccaaattaccatgccaaagccattccatttgttggtattcttccttgttgctctttgtctatgcaccaattcaaatgccagcagtagtactaatgagttccttgaaactgagtgcttgaaagtaccagcaactgagtttataggttctttgaaaaccaccattgatgctatacgaaaagctacctctgttgtttctcaatttggtggcttttttcatgattttcgtctctctaatgccatttttgattgtcttgatctgctcgactcttctgctgatgaactaagttggaccatgtctgcttcccagaatcctaatgctaaagataacagtactggtgatctaagttctgatttaagaacatggttaagtgctgcaatggttaaccaacagacatgcattgatgggtttgaaggtacaaatagcatggtcaaaactgtagtatccggtagcttgaaccaaatcacttcactggttcgtaatcttctcatcatggtgcaccctggtcctaattccaagtccaacggtacccgtaatggcagccaaaaaggtggtggtggtgggggtcatccaggccagagccggtttccggtatggttcaaaagggaggatcggagattgttgcaaataaatggggtaacagcaaatgttgtggtggcagcagatgggagtgggaatttcacacgcataatggatgctgtggagacagcaccagataagagtatgaacagatatgttatttacattaagaagggtttatataaagagaatgtggagatcaagaagaagaaatggaaccttgtgatgatcggtgatggaatggatgtcactgtaatatctgggaatcgtagcttcattgatggatggaccacatttcgatctgcaacatttgctgtaagtggaagagggttcatagcaagagacataacattcgagaacacagcaggtccccaaaagcaccaagcggtagcgttacggtccgactcggacctctcagttttcttccgatgtgcaatcaagggataccaagactcgctctacacccacacgatgcgtcaattctacagggaatgtaagatcaccggcactgtagacttcatattcggcgacggcgccgttttgttccaaaattgccaaatcttagccaagcaaggcttaccaaaccagaaaaataccatcaccgcgcaaggtcgcaaagacccgaaccaaccaactggcttctccatccagttctgcaacatctcggccgatacagacttattaccttcagttaactccactcctacatacttgggaagaccatggaaactatattcaaggaccattatcatgcaatcctacattagtgatgccataaggccacaagggtggcttgaatggaaccaagattttgccttggatacattatactatgccgagtacatgaataatgggccaggggctagccttagtgagcgagttaagtggcctggttaccatgttttaaataactcagctcaagctgttaattttacagtagctcaattcattgaaggagacttgtggttgccgtcaactggtgttaaatacacttcaggatttggggtataaatatataaatataactttatttatgtattttccgtcaaccggtgttaaataccttctgcaatctaatatatctttaattcccattctctctgcactaacaaaatatattagatttgtagataattattttgtattgcataagatagagtttatatacactttatgtaggagagacaatgtcatattctcccataatgctg

SEQ ID NO: 19 - DNA, 837 bp, Gossypium hirsutum
aataaaatttaaaggaaaatagaagccatttattatcattattattttcttcgagttttgccttcagattcttcctctttgtaagttcaaatctaaaaagccatggcaaatgcagcttctggaatggccgtgcatgatgactgcaagctgaagtttctagagctaaaggctaaaaggacataccgcttcatagtattcaagatcgaggagaaacaaaagcaggttgtcgtggaaaagcttggtgagccaagtcaaagctatgacgatttcactgctagcctccctgccgatgagtgtcgatatgctgtatacgattttgactttgtgactgctgagaattgccagaaaagcaggattttcttcattgcatggtctccggacacatcaagggtgagaagcaagatgatttacgcaagctcaaaggacaggttcaagagagagttagacggtattcaagtagagctgcaggcaaccgatcccaccgagatgggactcgatgtcataagaagccgtgccaactaaatcggagtctccaagaggcatgggtatttgaattcctttctgcttttgcttttagtgaaatgttaatagggttgcgggaggtggtaatatcgacctgactgaactttgatattggtttgttggttaagtttttttatatagaagtgttcggtctcgaacaaattatatggttttgttatgcgcagaggttgtatgaccggatgtgttcatagtttgattcattagaaccaaaagtctatctacttcagtggtatgaatatgacactatttcttttaggtttgttcttgcatgtataaaaatggatatttcggtta

SEQ ID NO: 20 - DNA, 999 bp, Gossypium hirsutum
  misc_feature (952)..(952): n is a, c, g, or t
cttcctcaatcttcttcttcctttttgttttctgtgtttttttttttagtccccaaatggattctccctttccgttcaaatggcaacccctcccctttcatcccctacttatctcaccaccaatttaggcgtcggctacgccatcgtcgtcgccctcggcttcctcctcctcctctccactctcctcctcgcttcctacatttgcttccgctcttcctcaccccttccacctcgtgccatttccccaaaccccatttcaacacccaccgccgccaactccgacggtatcgtcctccccaggattgttttcatcggcgaagaagaccatgaaaacgacgaggaaaacgtcgtcgtctttgggcttgatcgtgccgtcataaactcttaccccaagttccggttcagcaaaaaggaggtgtctacggcggtggaggtgacgggttctagtgctgggaacaccatttgttcgatatgtttgtgtgagtatagagaatcagagatgttgaggatgatgcctgaatgtaggcattgttttcatgtaacttgtattgatgcttggttgaaacttaatgggtcttgtcctgtttgtcggaactcaccgcttccgacaccgatttctacgcctttgtcggaagttatacctttgtctcagtacgatgctgatcggaggtggtggtgacttttggcttttgggttaccatctttttcattttttttttcttcaatttttttcctgtgtggaaatttggttttttgtcatggatgctttttttttggcttaatgaatggtgatttggtataaaaaaaaaaaaaaaaaacgcgagactagttctctctctttcctcaaacttcatggctcggaaattcttcgtcggcggcaactggaaatggaatgggccaaccgaggagggtaaaaaaatttttacaacattaaaataaacctaaattcccnccaggggggttgtggaggtgtgttgtgggccctccttgaggtagccc

SEQ ID NO: 21 - DNA, 1640 bp, Gossypium hirsutum
tcaccaatggaggaagccatagttatttacccagcatctatgcttactcacctggcacccatggtagagttcgccaagctcctcctcactcaacacccttccctttctatccacatcctcatcgccacccttccttcacaaccttcctccaccgttccctcccccgttcctccttccatcaccttccactacctccccacattcgacctccttccaacctcaaccgacttagatccgcttttcttcgacgtcatccgcctcagaaaccccgatgtccgtcgcacccttctcaccatctccaataactacacactcaacgccattatcgtcgacttcttctgcaccagcgcagcattcgaagtggcctccgatctcaaccttccagcttactctttcctccctaccgccctcggtgccgctgcttgcttactttatttgcccaccctctgtaacaaattcactcaaagcttccaacatctcaacgttctccttgatatccctggtgctccaccgattccatctgcagatatgccgccgacaacgttcaaaggcaacaagctgtatgacgttttcttagacatcgccaccaacttgccccgttcaactgggattattgtggacacttttgaatatctcgagccaaagagcttcaaagagattaatgatggactctgcttgccggactaccccacgcctcccctttactgcatcggacctctcattgttaacaccaccgtggacggtgatggtgttcctcagtgcatcaaatggttagactctcaacctagtaaaagcgtagtgtttctttgttttggtagcttgggatcgttttcagtgcaacaattaaaggaaatagctgttggattagagaggagtgggcagagatttttatggattgtgaggaacccaccattagagaaccaaagcttgaacattgacacaaaagtcgacccagatttgaaatcattgcttcctccagggttcttggagaggaccaaagagaagggactggtagtcaaatcatgggcaccccaattagccgtgttgaatcacgactcggttggtgggttcgtgactcactgcggctggaactcagtgctagaatcggtgtgtgcaggggttccaatgttagcgtggccgctttatgctgaacaaaggttcaacagggtgttgatggtagaagaaatgaagattgcgttgccgatggtggagtcggaaaccgggttcgtgagttcaactgaggtggagaaacgagtcaaagaattaatggggtcgaaagaaggtgactcagttagggagcgagccttagccatgaaacatgcagcgaaggtggcgacgagtgagggaggttccactcgcattgcgctggccaaacttgtcgagtcatggaagcaaaaatgactcggactgaatcgccaaaccaccacgtaggttgtgaggtaaaacccatggtcaataagtgaaacacgagcgttcgactcggtcgttataatccctattgtgctgattcgacaaactgaaaacgttgttcgaattattatttttattatctttgttgttgttgtattgattatattatgcttgtatttttaattaattaattaaataatatccttagttcaaataaaaaaaagaaaaaa

SEQ ID NO: 22 - DNA, 2572 bp, Gossypium hirsutum
accttcccatttttctgtagcaccccccaaaaagcttgtgcttggatatggctgaaaacccagtaaaatggctgtttctcattctagcaagctgcctgtgtttcgctttcgtcctgtcggaaagcaactcattaataaagaagacctacatcgtccaaatgcacaagtctgcaatgccagcatcattctccagtcctctggaatggtactcatcgaaattaaagtcggtaatgtccgatacccagagtgaaggtgaaggagatggtgaaaataggatcatctatagctaccaaaatgcttttcatggtgttgccgctcagttaactgaagaagaagctgagaggctaaaacaagaagatggtgtagttgctatacttccagagaccaagtatgaattacacaccacaaggagtcctatgttccttggattagaaccagaagaaagtactagcatctggtctcaaaaacttgcggatcatgacgtcatagttggggtacttgacactggaatttggccggaaagtgctagctttaatgatacagggatgacacccgttcctcctcactggaaaggaacatgtgaaactggacgaggctttaaaaagcatcactgcaacaggaaaattgtgggtgcaagagtattctaccggggatatgaagctgccactgggaaaatcaatgagaaaaacgaatataaatcacctcgagatcaagatggacatggtactcacacagcagccactgttgctggctctccggtacgaggtgcaaatcttcttggttatgcctatggaacagctagaggaatggctcctggtgcaagaattgcagcctacaaggtttgctggactggtggatgcttcagctcggatattctgtcagcggttgatagagcggtgggtgatggagtgaatgtgttgtcgatatctttgggtggtggagcttcatcttactctcacgacagtttggcgatagcaacttttggagcaatggagatgggtgtttttgtctcttgctcagctggcaatggaggaccagatcctgtcagcctcactaatgtatcaccatggatcactacagtcggtgctagcaccatggatagagattttccaggtagtgttaagctagggagtgggagaaccatatctggagtttcactctacaaagggcgaaggttactgcaggcaaacaagcaataccctcttgtttatatgggtagtaactcaagcagccctaatccaagttcattatgcttagagggaactttggatccacatgttgtttctgggaaaatcgtgatatgtgatcgaggaataaatcctagagtgcaaaagggtcaagtagtgaaagatgctggaggagtagggatgattttgacaaacactgcagcaaatggggaggagcttgttgcagattgtcacctacttccagcagttgcagtgggagagatggaagggaaagcaatcaaacattatgctttaacaaatgggaaaccaaccgcaactctagcctttttaggtaccagattgggtgttaggccatcaccagtggtggcagcattttcatctagaggaccaaatttcctcacacttgaaattctcaaacctgatgtggttgcgccaggggtgaacatccttgcagcctggactggagaattgggtccgtcaagtcttccaacagatcataggagagtgagattcaacatattatcagggacttcaatgtcatgccctcatgttagtggaattgctgccttgatcaaggccagacacccagattggagtgccgcagcagttaaatctgctctaatgacaaccgcttatgttcatgataacatccataatccactccaagactcttccactgcagcagcttccactccctatgatcatggagctggtcatatcaaccctttgaaagctctagacccaggtttgatctatgacatttcagcccaggattactttgtattcctctgcacacagaaattgactgcaatgcagctaaaagcttttagcaagcattccaatatgtcttgccatcacaacacccttgccactccaggagatttgaactacccagcaatctcagttgtcttcccagaagatacagccatttcaactttgactctccatagaacagtcacaaatgttggtcctcctgcttcacattaccatgttgtagtttcaccatttaaaggcgtcaccattaaagttgagcccaaaactctaaatttcactagaagaaaccagaaactgtcttacaagatcagtttcacaagaaaatccccacaaacaatgcctgagtttggagggctggtgtggaaggacggagtgcacaaagtaagaagccccattgctatcacatggttaccaccattttaaactagattttcagtcacctatgattccaaataaacattatgtttttatataaggtcaaggggatctttaattttatctgcatttctttctggttttttcaacaattttgtagccttcacatgatataagagcaattaaaaaccaattgctgtaaaaaaaaaaataaccaaaggcgaggggggcccgac

SEQ ID NO: 23 - DNA, 1254 bp, Gossypium hirsutum
gacgcctacagaagtaaaggaaaggatcttgaagggaaggatggattgaatgccgccaactggttcattcccaaactctttttaaactttttcagtcaatttgtgactctagagtgttgctggattctgatgtactctttataaatttgatagaccaagttcgacattattgagagcaatgatggatttgtagtgcatttcgcgagttaaatttgtaactagtttaagctaaaaataaatgcaaaggttggacctttggaagctggactgatctccaagccatctctcttcagtcttttaagctccgcttttgctaaaatcaaatcagtttctcccctaaatttactgaaattttatagcaagactccttatttctccgatgtcgatcttcgaatacaacgggagtgccctaatagccatggtaggcaagaactgcttcgccattgccagcgatcggagactcggagttcaactccaaactatcgccaccgatttccagaggatttataaagtccacgatcgcctcttcctcggtctctccggcctcgccaccgatgctcaaaccttgtatcaaaggcttgtctttcggcacaaactgtatcagctaagagaagaaagagacatgaaacctgagacttttgctaaccttgtttctgcgattctttacgagaaaaggtttggtccatacttctgccaacctgtaattgctggattaggagatgaagacaagcccttcatttgcaccatggattccatcggagccaaggagcttgcgaaagattttgttgtagctggcactgcctcggagtctctctatggtgcctgtgaatcaatgttcaaggagggcatggaacctgaggaattgtttgagacggtttcccaagctctcctttcatcagtagatcgcgactgtctgagtggttggggaggacatgtctatgttgtgacgcctacggaagtaaaggaaaggatcttgaagggaaggatggattgaatgccggcaactggttcattcgtaaactccttttaaactatttcagtcaatttgtgtctctagagtgttgctggatttgatgtactctttataaatttgatagaccaagttcgacattattgagagcaatgatggatttgtagtgcatttcgcgagttaaatttgtttttttgtattgtttctttaaagataagatgcatgggatttttagacttgcaagttgcaactaagctaaaagaaaattcgaaattcatggctta

SEQ ID NO: 24 - DNA, 1968 bp, Gossypium hirsutum
ctccttctcaccagtcccacaaaaaacatcccagaagaaatccctggaattccacttctctccttgtctcactatccatgtctgcttttcttctcctttcccttctttccctctcccatttcttcatcttctcttcttccagtcatcacccacctcataactcccctgtttacgcctctgactcctctcgaatccgccttgcttgcaaatccactcgcttcccacaaccctgcgaatcctccctttcgcgatcctctcttctccctcctaatccgacctccctccaattcatccaatccgccatttccgtctcttccgataacctcaaaaccggacaatccatggtgaaatccatcctcgactcctccaaaggcaacctcaaccgctctaacgccgccgccatctgtctcaacatcctttctaattctgattaccgcataagatcgaccaatgacgctctggcacgtggcaagatcaaggacgctcgtgcgtggatgagcgcggccctttgctaccaatacgattgttggagcgcgctcaagtacgtaaatgacaccaaattggtcggtgaaacgatggcgtttttggactctttaacgcaacacagcagcaacgcgttgagcatgatggtcgcctacgataatatcggggaggacatagccgcgtgggtccctcccaagacggaacgggacgggttctacgagaacgggtcgggtgggacggagctggggtttaacgggggtttaccgtcaaacttgaagacggacgtaacggtgtgtaaagacgggagcggagggtgttacaagacggtgcaagaggccgtcaacgcagcaccggcaaatgcagagagtacacgccgtttcgtgatatatataaaggaaggtgtgtacgaagaaacggtgagggtgccactggagaagaaaaatgtggtctttttgggggatggaatgggtaaaaccatcattgcgggtgctttaaatgcagggatgcctggacttaccacttatgagactgctactgtcggggttcttggggatggatttatggccagtggactcacaatccggaacacagcaggccctgatgcccaccaagccgtagcctttagatcagatagtgatctttctgtcattgagaactgtgaattcctaggcaaccaagatactctctacgctcactccctccgccagttctacaggaagtgccgtattcaggggaacgtggacttcatcttcgggaattctgcctcggtgttccaagattgtgaaattttggttgctccccggcaggtaaaacccgaaaaaggtgagaacaatgctgtgacagctcatggtagaactgatcctgctcaatcgactggtctggttttccagaactgcttgatcaacggaactgatgaatacatgagatactattatagcaagcctaaagtgcacaagaactttttgggaaggccatggaaggaatattcaaggacagtttttataaattgtgttatggaagcacttattaatccgaatggatggatgccatggaagggtgactttgcattgaaaacactcttctatggagaatttgggaattctggtcttggatccattccattgaacagagttccatggagtactcaaattccaccccagcatgtacatacattttcagtccaaaatttcattcaaggagatcaatggattccaacatcatcttgattccccccaggaatcatgttgattgcaaagttaagatgataagaattccaagaatgtaaacccaaggaaagtttagctaaacatgatcatattcatctgtaacaaaatcttcattggagaatgaagggttagtgccttagcctacgctattttgtccttttcatttttcctaaattatctgtatatacatatttgaagtttgggtgtgtaatggaatatgtttctcaaatatatagaaaaacatcaaaaattgtttagt

SEQ ID NO: 25 - DNA, 2184 bp, Gossypium hirsutum
gcaaagctaagtttcaaagccctagtgagcaccggcacagctagtctaaaccttgcattagcctccgctataaatagattgcctaacatcacaaaccataagctatccaaagtccctacgacacccatcctggttttacgtactgaaacatggattgtaaatcttggggttccagggatattgtttttttgtgcattattgttttgtctttgatccatgtttcattgggtgcaaaggttaggcatttcaaatgggaagtggaatacatgtacggagctccagattgtcaagaacatgttgtgatgggtatcaatggccagttcccagggccaaccattagagctaaagcaggagacaccattgttgttgatctcactaacaagcttcataccgagggagttgtcattcactggcatggaattagacagcttggaacaccatgggcggatgggactgcttctatttcgcaatgtgcgatcaacccaggagagactttcgaatacaggttcaaagttgataggcctggaacgtacttctatcacgggcactatggaatgcagagatcagcagggttgtatgggtccctgatcgtggatatggcagatggtgaaaaagaaccattccattatgatgctgagtttaatctcttgttgagtgattggtggcacaaaagtgttcatgagcaagaggttggcctttcctccaatcccttccgttggatcggtgagccacagagtctgctgattaatggaagagggcaatacaattgctcattggctgccaaatttagtaattcatcaattagccaatgcaagttcgaaggaaatgaaaaatgtgcaccccaagtcttgaaagtccgaccaaacaaaacctacaggctcaggattgccagcaccactgctttagcttcactcaacttggccattgagggtcacaaaatggtggtggtggaagctgatgggaaccatgtgcaaccatttgctgttaatgatttggatatatattcaggggaaagctactcagtgttgttaaaaacagaccaaaacccttacaagaactattgggtttcaattggtgtcagagggagagatcccaaaaccaaccaagccttaacccttttgagctattctgccacccctgcatcaaagctccctacaactcaaccccctgtaacacctcgatgggacgattacaatcacagcaaggccttcaccaaaagcatatatgcactcatgggatcacctcagccacccaagacttatgaccgtcggatcatccttctcaacactcagaaccgactcaatgggttcgtcaagtgggccatcaacaatgtgtccttggtgttgccttccactccttatttggggtccattaaatttggtctcaacaatgcttttgaccaaaaaacacccccagacaactacgatagcagctatgacatcatgaagcctgcacccaaccagaatacaacacaagggagtggggtttacaccattactttaaacaccactgtggatgtgatccttcaaaacgccaacgccttagcaaaggatgttagtgaaatacatccatggcatttgcatggacacgatttctgggtgttgggatatggagaagggaagttcaaaaacggagatgagaagacatttaacttgaagaacccaccattaagaaacactgcagtgattttcccatttgggtggactgcattgaggtttgttgcggataatccaggggtttgggcatttcactgccacattgagccacatttgcatatggggatgggggttatttttgctcaaggtgcccatcgtgtaggtcaaataccaaaagaggctcttgcttgtggattaacaggaaacaagcagaactgagagactgatttgagctaatttatgtattaggctatttggtgtcaggctttttttctttatttgctggtgtttgttagatggggttggtcttggttaaggaaaaagggtaggctacttgtcaagggctagccatggacaacggttctagtttgggcctggtcttgtcttggtataatatgtatctcatgtcaggtcatttgggcattggctaaagtctccaagtccatcttgtttcaatgggttgagggaaactatgtttgacaacttgcaagtcgcaactaaacttcaataatatcgaattccgctattg

SEQ ID NO: 26 - DNA, 1884 bp, Gossypium hirsutum
caactttggatctttcgggtaataatcttactggcacaataccaacagagctcactacattgccgaagcttgttcgattagatgtttcgaacaacaggctctatggaaaagtaccacctttcaggcaaaatgtggcggtgataactgctggtaaccctgatataggaaaagaaatggcttctccaccagctggcaagtcccctggtggatctcctgctggcggcggcggcagcagcggcagttcctctggaaatggtgaaaagaaatcgaatacggggactgttgtgggttctgcaattggtgcggttggtggcttgagtcttcttgttttgggtatccttttgtatgctagaaaaggaaagcgtaccagtaaagtgcagagtccaactactgtagtcatacaccctcatcattccgatgaccaggatggagttaaaatcactgtcgctggatcaagtgtcactggtggaagtgaaactttcagccacacgagcagtggaccaagtgatgttcacttggttgaggctggcaacatggtgatctcgattcaagttttgagggatgtgacaaataatttcagtgaggaaaatgtgttaggaaggggtggttttgggacagtttacaaaggggaattacatgatgggacaaagattgctgtgaaaaggatggagtccagtgttgtgagcgagaagggtttggccgagtttaagtccgagattgcagttcttactaaggtacgtcaccgccatttagttgcacttcttggatattgcttggatggaaatgagaggcttcttgtatatgaatatatgcctcaagggacccttagtcggcatctattcaactggaaacatgaaggtctgaaaccacttgaatggactagacgacttacaattgccctagatgtcgctcgaggtgttgagtatctacatggtctggcacaacagagtttcattcatcgagatcttaagccgtcaaatattcttctcggagacgatatgcgtgccaaggttgcagattttggcttggtccgtctagctcctgtggatggcaaacagtcaattgaaacaagactagcaggaacctttgggtatttggcaccggagtatgcagttactggacgagtaaccacgaaggtagatgtgtttagctttggtgtgatcctcatggaattgatctcaggccgaagggcacttgatgaaactcagcctgaggaaagcatgcaccttgtgtcatggttccgtcggatgcacatgaacaaagaaaccttccggaaggccattgatgaaacaatccagcttgatgaggaaacgctagccagtgttagcacagtgactgagcttgctggccactgttgtgccagggagccctaccagaggccagatatgagccatgcggtcaatgtgctgtcatcactagcagagctctggaaaccagcagaacccgattccgacgacatctatggcattgaccttgaattaactttaccccaagcattgaaaaagtggcaagccttcgaggggaacagcaatgtggatgactcctcatcatttctgggcagtacagacactacacagaccagcataccatgccggccgccaggttttgctgattcattcgcatcagctgatgctcgatgaaagacacaaagaacaacaacgcaagtttctagtgtcaaatcgattgttccaagatgtttgggtttgttcattccttctacttcttcatttcccattacaatctttgctctcatcagttatagtttgtcagagacggtttctttctcccatttatttatctcactagtttgaacaactgaaattttcgaatgtcttgtacaagttatggaaatgcaatcgagtgacgacgtatcttgcatgtcta

SEQ ID NO: 27 - DNA, 1343 bp, Gossypium hirsutum
gcacgatgcttttgttgtgaagaaaaaaatggttggtgtgtttaggttagtgagggggtatccgggaccaagtggctttggttcagcctccaccgcccaagaggttaccgaagggattgatggaaccaacttgactgctctagttaccggaggagcaagtggaattgggttggaaacttctagagtattggctcttcgtggagtccacgtcatcatcggtgcaaggaacatgaaagccgcgaatgaagcaaagaacaaaattgttagagagaacacaagagcccgtatagatgttctggagctggatctttgctctactagttcaatcagatcatttgccgacaatttcattgctcttcatcttcctcttaatatcttaataaacaatgctggcatcatgttttgtccctttcagctttctcaagatggaatagaggtgcagtttgcaactaatcatataggacatttcctcttaacaaaccttctactggacacaatgaagaacacagttaaagcaactgggatccaaggaaggattgtcaacttatcatcaatagctcaccactactgttataataaagggatccgatttcataagatcaatcacaaacaaggatacagtgagaaaagagcatatgggcagtccaaattagcaaatatattgcatgccaatgaactctctcgtcggttgcaggaggagggtgtgaacatcacagttaattcggttcacccgggattgattatgacgcctctgtttagacactccgctgctctgatgaaacttttgaagttcttcagtttctttctctggaagaacgttcctcagggggcagctacgacgtgctacgtcgcgctccacccgcgactcaatggggtgaccggaaaatactttgcggactgcaatgagatgagaccaagttcatatgctagaaatgagtccttgggaagggagctttgggaattcagtaacaaattgattagctcagtttcagaaccttaactcagatcatcacctctctttccaaatggcaaaaaaaaaaaaaattgcacttacgtattttcacattaaatggggtttcctccatggcatggcatgaatgaagggatgattttcagcatgggaaatcttgaagcataataataagcttaaagtgccttttactttctcgttttcgtgttaaaggcatcatactatcatagcagttggtttcctaatatgtgtgaattttcagtgtttcaaaggaataaaattctttctatattattcatattagtttattttatacggattaattattgtatgtatcattttaattatattataatcatattattcaatatac

SEQ ID NO: 28 - DNA, 713 bp, Gossypium hirsutum
cttatattttccctctcaaataacagcaacgaagcaacttttaagatatcataaaaaggaaagaaaaaaatgaagctcttgtttctaactttgctgctttgttctcttcttctatgttcttcagtttttgcaccaacaatggctcagcctcgttcacctttttgtgaagggaaatgcaaagggaggtgcaataaagcggcggtttgggatcggtgcttcaaatattgcggcatatgttgcgaggagtgtcaatgcgttccgtccggtacttacgggaacaaacacgagtgtccttgctacagagataaggtgaacaacaagggcaaacccaaatgcccttgaaaatgaaatatattcgagttcgggatttaatcaagcttaaagatcgaggacgaagaggccatatatatatatatatatatgcatgttgatgatgatgttattataaaaataaacttgttttgttgctgttattttcctttgggtttttgtgttggtagtgttgaataatatttcccttatattttccctctcaccgccgtgtccaccgccatgcacacatgttttgttgtcttttgatcatgggtggtggtgatgatggtgaaaatggtgtcattcacaggtgtctgcagggttggtaaaatgcatttaaaaagtagaaaaatgttgtaacctttttcaacgaggtttatgagtaatttaagaattttgtt

SEQ ID NO: 29 - DNA, 1365 bp, Gossypium hirsutum
agtactaagcgacggcgttttcatcggtggtttactcgttgaccaggttggttagttctggttcttatttaaacagtgtcgtctcgtcgaatgagaactatcttttttctttctcttkggatctcttctctgctcccaaacccatccaacatttttaaggtttgttatgtcggaagtccctgattttctggtctaagattctaagtagttaagagttagttgtaatttatttttattgttattgttctgtcaaaatgtggagttttgcttcaaataccattgctagcattgggttaaagagttcaaaagaggcgaatcaagcttgttccgagtgttcagatgatgagctgtgttcaaatggtagtagagatgaaggattagagtgtcccatttgttgggaacctttcaacattgttgagaatgtgccttatgtcttatggtgtggtcacactctttgccaaaattgtatcctgggtctccaacctgctgttttgaaactccccactcagcaaatcaagatccccatgttcatttcttgcccatggtgccacttaatagcgctacggctagtttataaggggaacctcaagttccctcggaagaacttcttcattttgtggatgatcgagagtttgaatggggataggtatggcatttccaggagaaatctatctggggacaatcaagccgttggctctctgagatgtaatttaatgcttggcaatcaagctatcagtggtgttgttaggagaggatcatatgccaatcgttctgaacaaaataggtctctagatactggtggcagaaataatgctgagaggcatcatttctcgcttcataaatcattggatttcttcattcacttyacatccaagttcccattggtcaccattttccttctggttgtcttctttgcaataccggggagtgctgttatcttattactccactttctggtcacagttgtttttgccatcccgtctttcttggtactgtactttgcattgcctatgttggataggttggtaagagaaatcacctcatgagatgttgctttctcacttcaaaggtcaaagagatatatggttccragtgaacacatctatccgtgwgatcatccttcttmcaatgctcgctccactgcttttatttgaaatttastagctccacgctggtaatgggattttttagtatcctgaakctttcagattaatgcattgtttttgatatggactgtgactgagtgacttcaaaacatctcamaagcttgttttggaaattgtggttgtgcccttaattaaatgtcattgaaatgtcaacttacttgttgtacaagcttgagttctcacaagaatataatttgca

SEQ ID NO: 30 - DNA, 837 bp, Gossypium hirsutum
gatacgccagaggaactattgtcaaatgaaggaagttctttctccaagatggttcaaagtacaggggatgctaatgcacaatacttacgaagtctagcactcggagggggagaggacagtgtaggcagagaagtgaatgggcagttggataaacagaggaaatggctggcatcttctcgatgggctgctgctgcccagtttgcactcgctgttagccttacttcatcgcaaaatgaccttactcgcttggaaattgaagatgagaacagtatcctcaagaaaacgagagatgctgtgataacccttcagggagttctggaagggaagcatgataaaacaatcgaagagtccctagatcagcgtcagatgtctaaagatggatggtggtcagcactttacagaatggttgaaggtcttgctataatgagcaaattggcaaggagcaggcttcatcaatctgattatggtttcgaagacagatcaatcgactgggatcaaactgaaatgtagagttcaatctctcccgtctggattttggattcataactggaatgcgttttggagtgtagcatctgaaaattgtccaaagtttacatcaaggattgttagccatgaatctgtcttattttttttttgtaattttgagcttgcgcacaaaattttgaaccccataattgtcggacaatttagttgaattgttaaaagaactgcattataattatgaacttctattttcaattttcttttatccattttataattatgagtgattaggttcaatttattgaattgtttttgttttacttttctgtaaataataaagttttaagcaaaact

SEQ ID NO: 31 - DNA, 855 bp, Gossypium hirsutum
gggatcattctttgtcgtaatcttgtttgtactccttaatgggtggcttcgcatctgcaagcgtcagcggagagaccaagagctgatggagtatgaggttgttgaagagatcatatatggcttggaatcaggaattttgtttggaatggcatcggtgatatcaaagataggatttgtcttcgtgcagcagggcttttccaaaatgttgattcctctatgtgtctcaatcagtatatgttgtagtggtactggattttactaccagactcgcggcttgaagcatggtagagcaattgtgatatccacttgtgctgctgtggcatcaattgtgactggtgtactggctggtatgctcgcattgggtgaacggttaccttcagcaccagttgctcgtctttctcttctgcttggatggttatttatcatgatgggtgtgatcttgcttgtgagctcgacgagactgatgcggcaccttccatggccattgcagaacttaataccaagtggagcagaccggaatttcagtctgaggaaaacagggtctcatcgagtcaaggatcctagcccagctgctgttatcccagcagcaacattgcaccatctgataccaacaccggctaaggagaaggcataggcaaaggatgcaaaagatcactgcataagcagacgaatatgacaatctccgatcaacttttgagtcttcagtctgggtactgtttycatttcggagggcatgaaattttttaagatcactctcccactgatctgtttgacattattgacattataacgtttgaaaattgtaaaatattaccattctaaaattactataagacaatatacttagtttcttgc

SEQ ID NO: 32 - DNA, 1566 bp, Gossypium hirsutum
gccgcagtcaaagagctgctgggacaatatgatcagcaatcacctgcaaaagaaaatctcaaattctctgaagaatgtctacaagcaattagcaataatgatgtcgaggataacgtggttccaatagtagtaaggccaggacatattcgctttgagccccttgaagaagaagatgctgagcaagctatccaacacagtcaaatttctgtgaaaacctttcaatggaatggaataaccagcaagaagaagggtcaaaaatggggtatggagaaaactccttttctgagaaggaatgataacaattttagccatgtgagttcagaaatggtggatgttaacgataaggccactgtaactaatgacatggactttgacaagcttatgccctattctagcttgcctaaggagggagatttagttgcatatcgcttagttgagctatcttcaacttggacccctgagctttgctccttccgggttggagaaatatcacattatgatgctgaatccaacaggattatgctgacaccagtgccaggatatccaaatgcctctgggaagaaaacagatgaggaggcttctgaactaccagatacatctctttacggaraagatggktcattagagatagattattcctctctaattgatgtccgcctcgtcaagcttggcaattcaaatgccacaatagcaattgctgatgacaacaatgaaaattatgcacaaaatcaagatgttttaacaagacaaccaaatggcagcaaggaagcaaacagtgtctcagctgcatttcctgcacaagctaatggtgcrktcaattatggaagaaattaaccaggctttgagtcaaagaagctgagctctctaaagagatgttgartcgagcagatagttcaggtaggagcgcctggtcttttagggctctcagacgcagtgctcttggcccaactatggccttcttaagagcacagaatgggatctgaggattggcaccagcatcagttttaagtgtagtttctcaatgtttttgaacctctgaaagacgagagcaaggcaattttgttttggcttttgctttgtcaagtacacaaaattttcaagtgtcgtccraagttaacgtcttttgtgtagaatgcgaatgcgctggttttcacttgttttactacagaggagttttaatctctkcatatttaattccatgagggcgtattttttggcggagatagcttgtttatgagcagcagattcagatttaatcagatgaattactgattgtcgaggaaagtcttcaatcagagctgcttcactttgaagagttgcaagagatgttaactcgaggagtaaaaattctcacaggcttggaggttggcacttgaaagttgaaagttgaaacttgaattcaattatcatttacagataattaaacaatcaccttggtagataatgcaaataaaggtgacgatgctgaaggcttggattgaacatgtttctatacaaacaaggcaacatctttggtgcaactgaaagactatagaaatgattgcaactgagtatttatttcaagtt

SEQ ID NO: 33 - DNA, 1113 bp, Gossypium hirsutum
gttcttggccatggcaaattctaagggctcaacaaacataaggaactttatggtttctggaaagcatgctttacttcctccgaaaagtccatttcccactgtttccccagcatatactgattatgtccccaacaatgttattgggtcaaaagcagttcaaaagcctagagaaggaaatacacatcaccaatgcacttcctctgaaagcctacgaatggaggaacagccttcttggcttgacgatctccttaatgaaccagagactcctgtgcgcagaggaggtcatcgacgttcttcaagtgattcttttgcatatattgatgcatctaatgctcctaacctagattatgcagctcaggatgagttcagatatcaaaatatgattaacacaccatcttgggcatctcaagatgctaagctttcctctctctacagtgatgtgaacttggtaaagcaaaagcatagagcatgggattcatctttgaatgttgtgactcatccaagtgggcttccttctcttagagaaaacacatttgttcagagtttaggatcatgtgcaccacaagaactagagcgagcacaatcaacagcaaatggaaaacaagattcaactaaatctgtccctattgatgcaaaagcttcttctgagaaaaaagataattctcatgccaagtcttctgcatctgacagtgacacgaaaagagccaagcagcagtttgctcaacgctcaagagtgcgtaaacttcagtacatagctgagctggaaagaaatgtacaagctttgcaggctgaaggatctgaagtttcagctgagcttgaatttctcaaccaacagaatcttattcttagcatggagaacaaagctcttacgcaacgtttagagagtttagctcaagagcaggctatcaaataccttgagcaggaagtattggagagggagatcggtaggctacgagtcttgtaccagcagcaacaaaatcaacagcaaccgcaacaaaagcagcaatcatttagccatcgacgctctagcagtagagatcttgattcccaatttgcaaacctctctgtgaaggagaaagatactagttccagccatgacaccgtcaccgatcc

SEQ ID NO: 34 - DNA, 478 bp, Gossypium hirsutum
ctgtacccttcattcaaaagctaatggcagaggtgttaggcacgtacttcttaatatttgcgggttgtgcagcggtggtagtgaatgtaaacaatgagaaagtggtatcactaccagggatttccatagtatggggattagctgtaatggtcttggtttattccttaggtcacatctctggtgctcatttcaaccctgctgtcaccattgcttttgctacctgcaaaagatttcctctcaaacaggtccctgcttatgtattagctcaagttattggatcaacactagcagctggtacacttcggttgttatttagcggaccacatgatgtctttgccggaacattgccgcaagggtccgatttgcaggcttttggggtcgagtttcatcattactttttacctaatgttcattatatctggtgttgccactgataacacagctattggagaacttgctggacttgccattggtgcca

SEQ ID NO: 35 - DNA, 752 bp, Gossypium hirsutum
  misc_feature (706)..(706): n is a, c, g, or t
atacctggattatttggttacgccattgttcaatcacaagttcgtttcttccaatcccagagcttggttcttcctatgatgtttagttctcttgcaacattgtgttcccatataattgtttgttgggttttggtattcaaatttgggtttggaagcaaaggaggggcattggctatcagtttctcgaattggtttaatgttatattgcttgggttttacatgaratactcaccttcatgtgagaaaacccgaaccctccatttgaaagatgttttcttgagtgtcaaggagttctttcattttgccataccttctgcagtaatggcttgcctcgaatggtggtcgttcgagattcttgtattaatgtctggacttctgccaaattccaagcttgaaacatcggttctttctatatgcctttcaagcgattctttgcattatactatatcgtttgggattagtgtakccgccagtacacgaatttcgaatgaattaggagctggaaatccacaagcggctcagatagcaaccctagtttcaatgcttattgcactcgtggaaacactcattgcaagtacaatccttctctgttgtcgccatgttttcgggtatgcttacagtaktgaaaacgacgtcgtaatcaaagtaacacgaatggttccattgatctgtctctcatttattaccgacggtttacatggagtancttgcgggatcgtgagaggtattgggtggcagcatgttggagcttc

SEQ ID NO: 36 - DNA, 1366 bp, Gossypium hirsutum
  misc_feature (1246)..(1246): n is a, c, g, or t
gaccactcgtccctttctccttaacagtttgaggcagcgaattaacccaacaaaacccaacctctgggtatgggtttactgctcctcttccgcttctctctcttagtcttattgttttttcttttacagcactcaccaacaaaaggtgaggatttcaatgccataaataataccamtgscagtggcasaaccagaagcttagcttctaactgcaactggttcagaggcaagtgggtttatgacccttcctatcctctctacgacccctacaagtgccccttcmtcgagggtgaattcgactgccaaaaatatggtcgacctgataacacgtatctgaaatacckatggcaacccttctcctgcagtctccccaggttcaatgggctgtatttcttgaggaaatggaraggaaacaagatcatgttcgtgggtgactcactcagcttgaatcaattccagtctttgacatgtatgattcaggcctgggttccaaattcccagatttcatacatcaaacgagatggtcttacttcagttacctttctgggttatgatgtgaatataatgctgtatagaacgccgtacctggttgacatagtgaaccagaagtatggaagagtgttgaagctggactcaatcaggggcggtgattcatggaaaggagtggacatgctgatctttaacacgtggcattggtggacccacaccggaagaacccaaccatttgattacatagaagacggtgggaaaacgtggaaagacatgaaccgtatggttgctttttacaaaggattaacaacgtgggctagatgggtgaaccgcaatgtggatcctttgaaaaccaaggtttttttccagggcatttctccaacccattatgagggaaaggattggaacaagccaacagagtcctgctcgggacagacacaaccattcttcgggatgagatacccaggaggcacacccatggcttgggttgttgtgaagaargtcctgagtaggattaaraaaccggtgtttttgctcgacgttaccggactctctcagtaccgaaaagatgcacacccgtcggcatacaraggcatggacggkgactgactgtarccattggtgccttccaggtgtgccagatacttggaacagtttactttatgcagctgttttttagtgaatttaggcaggaagatggaaaaccatttgttttccaccctaaccaacttcctttttctgtgatgagcaataagangaaataatgatatcataattcaagtgtaaattataatttgtttgaacaaatttgatttgctcattccaactattgtaatttttctattcttgtgcgtcatttttagaaataaatgtaagg

SEQ ID NO: 37 - DNA, 1252 bp, Gossypium hirsutum
ttttgccaacaaagatatacgcattattatttacccttttctttctatttttctcttttgctttcttttaagttttaagcccagcagaagtcaacaacaacactggttttttttttttttctcaaagtaattagcccatttaacacagtaaaagcaagcttttattacaggaacaaaaacatgtttgcaggagatcagaatggtttacaaggtgacccaaggttgaaggccatttctgaagccattagagttgtgcctcacttcccaaaaccaggaattatgttccaagacataacaacactgttacttgatcacaaggctttcaaagatactgtcgacatctttgttgatcgttacagagatatgggtatatctgttgttgctggtgttgaagcaagaggatttatgtttggcccctcaattgcactggctattggtgccaagtttgttccgttacgtaaacctagaaagttgccaggagaggtgatctccgaatcatacgtacttgaatacggcaaggattgtctagagatgcacgtcggagctgttcaacccggggaacgtgccttagttatcgacgatttggtggctacagggggtaccctttctgctgcaatacgcctactagaacgagccggggctcatgtggttgaatgtgcatgcgttgttggcctgcgtgaggttaagggacaacatggactaaatggaaagccattgtatatacttgtggagccacggcagcagattaattgttctgcaccttctgttaatggagttgaaacatgcagacacgacgatctgattctgggagcaagctttggttccccactcaatcccacttcaaaaagtgattagtgtttttttttggggcggggttaacctttggttgtaatttgtaatcctctttgccgtgaaagatgttcatctgtacttctttttgaggatcttttacttttacttttcatgtaagtttttaatctatctatttatatttttgtggcatttcagtacctggttcgttgtttattcaatcttatcataaatattttctattaacacttcaattatataaatagaaggaaattttaaattagtctttttttggggcccccatttttatttgggggggaattttgggaaaattccctcccctggggggcccccgaaaatggttttaaaggggcccattccccccaaaatacccaaattaaaccccttggaaaaaaaccccctttttccccggggccccccc

SEQ ID NO: 38 - DNA, 1482 bp, Gossypium hirsutum
cgaatctctttgtaaaaagtggtatcaaaagcttacctcactctctcccctgaaacaccattttcaattcctgtcattgaaaccccatcaaaggcagtgcaatgcttctctctctcttgcttttttaaatgcttttaatccctccccctagcccccgaatgaaaccctaaagaacccaccctcgttttctctttggattctctgtcttttctgttttcccccgtgttctttttttttgagttttacagccatggaagctctgaattttctcatgttttggaaacctagtaatggggttcataaagtaaatcaaacccaaccatgtgatggaaacggcgccgccgccaccgtcaccgtcactgccaccgccgcgtctggggttgtttcggatcatgagttggatgaaggggaggactctttcatcgacttggagtttcctctgcgtgattttaatggcaatggtggagctcgccgtgaactgcccaacaatgttgttggtaacaaagagcttagtttgtctcccgccgatcacttctcgaagagaaagattatgcctatcgagccaatctccaagccacaatcgcctattgctctgctaaaatcagctcagagatttcgagtctttactcccaagaaatctaaatcaatggcgaataccggtaacactacacgcctaccggagaaaactaagctcgtaggtgtttcaatggagaccccaaagcatgaaaaccataatagcagagagcatttcactagagaaaacagttttcgaagaacgaaaggcaaaatagaagatgatccttcgaagagattatcaaaagatttggtacataagtacttgaatgtaatcaaaccattgtacacaaaaatctccaaaaagcacagtcaaacccacaagttcgaagtgtccggcgacttatcaacgttatctccggcaacttctccggcgacggtatattctgtaaaggagaaacagggaaatactaatattaaagcgggttacaagcatctgggaaaaagccgatcagcctcggctgcagcgtcgccaattagccggagagatgattcactgctgcttcaacatgatgggatccaaagcgccattttacattgcaagagatctttcaattcatccaaagaatcttcatggttatcgagatgcacaagcgattgttcttcacaagagaaattaagcaatgcatcttcaacagagttttctctattttcacgagttgcaagcatttcatcatacgagaaactaatggattcagcaagaacatcaagcgaagaaggcaatggcttcaccacctgaaaaagtactgttaatagactttaaaaaaattcatgatcatgatgatgtggggtagtaattgttttttgattgtttagtttatgatgagcagtgagtagagagagtagttttcactttgtaaaggtgaagttgtctgtcattatgaaggaattgaaagttaactcttttat

SEQ ID NO: 39 - DNA, 1516 bp, Gossypium hirsutum
caatttttgttctcaaatcgaattcctttccgtttccttttattgtatggtatttttgtttactacaaacaatctaagagatttcaggatccctgccccagcagcagcaacgaaaccctagaaatctcccgtttcacctctcccttgtcaattgtgttggtttcgatgtgggataactgaatcgattgagagtgcgctgtgaggtgaaagaaaaaggaagaacaaaaaatgagcaggctatcgtttaggccacgcccattggacatacacaaaaagctaccgattgttaagtcagtcaaagactttgaagacgatgacactccaacttccgctactcgcaactctcaaatgctccgtcttgctgctgccgaagttgaacccgaggtgcaaccacttgctaccaagaaactggctcctgaaatacctacacctcagtttgttgttgtggatacttatgaaagagattattctcgcacgttctttcaacccacatcctatttacgagcaaggggagcccgggctgagattggagagtttgttgagtatgatctagataatgaggatgaagattggcttcaagactacaacaaagataagaagattcttgcacctgaaaagttggagagtctgctttttaagttggaggtgttggatcataaagctcgtgaaagagctggagttataacacctactcttgtttcaccaattcctgtgttgttgacgatggatgctgccattgaggccttgcaatctcaatccatcaaatatggagtctttcaggcggtttataattattggaaagaaaagcgtgaacggtggcagaagcctattttacgccgcttgcagcctcctccgccagttaatgataacaacccctacaatgtctttaggccaagggaaaaagctcacagacttcacacaagaaggatgcaaaggagggaaaacaatgtgcagtcgtttgaaaagcttcgccaggtcaggcgcaacctagatcaagccaagaccttacttgaggctttgattaagagagaggagaagaagagaaatgttctggaatgtgaagttagtcttcagaggatccaaatgaagtacaagcacgaaactgaactcctcgaagatattacgcttcctggatttccaccaatatctagcaagtttgcttctagtgaagatgagtttatggactcggatgaccttgcaaacagccgtccacgtacacgacctgctgcagttcagaatccacctctaacagattctaatgtargcatggctcctactgcaagcgttaagcaagagttccggcggcgacatttgytgcatggatggctacataaactggatcctcttgagccagttttgttgctcacaaaaccactagtttcggataaactggcagctgcaaacattgtacccccatctgattcttcaacaaaaatggtgcctctacaccaccctataattccatggaagatggggcgtgggggccgaaatgtgtttgacagatggaaatcctcct

SEQ ID NO: 40 - DNA, 789 bp, Gossypium hirsutum
gcggccgcgttgaccttaaataaaaaaaattcatcatgacaacccaaatgaaagagcttgaagatccaatggctctaatcacccaaatgtacccttgcatatacactcaagttgcaccacaacaaggggaaatatcgaagcctcgacgacgacagaagaagaacaagggaggggaaagtggggcggcaaccgcggcggagacagctaagaaaaggaagcttagccaagaacaagttgatcttcttgaacttaactttgggaatgaacataaactcgagtccgagaggaaagaccgactcgcttcggagctcggtctggaccctcggcaggtcgcggtttggttccaaaaccgaagagctcgttggaagaacaagaagctcgaggaagagtatagcaagttgaagacaatccatgaaggtgttgttcttgagaaatgtcgccttgaatccgaggttttaaagttgaaggaccaacttcgagaggctgaaaaggaaattcaaggattgacagaacgagtagacggagtttcgagtaatagtccgagttcgtcgtcggttctttctatggaagccatggatccaccacctttcctaggggaatttggagtacaaggatttgaggatcaagatgttttctatataggcatggagtggatgaatctatatatgtgactttaactttaatatgtgtaaataattatgatatttaaaaatatattaaatataatgtaattatatcctaattatcctaattaactttaaatttagagattaatgttattaactacta

SEQ ID NO: 41 - DNA, 1499 bp, Gossypium hirsutum
cgaggaacacaggtctcaggtacagttcctgattacctggtcaggttgtcttccttgtcacagctagtactttccaataatcagctttatggagatcttcctcaattcaaaccaaatttttcggtctatataaatggaaatccgcaacttcatcgtccaaaagataatcctccagtgttgagtaaaaaaagaaaatcagttggtgtgacaattgtcatcacatttgcagctgctgttcttgctgtagtggtagttgcaattgtatttctattgatctcaaaacgcttaagcaaggttaatgaggagcaattacagtcattggaagttttttctcctcctcgggtgattcaaggcaacatgttgacagcaaacggggtccatagatctaatattgacttcaccaaagccatggaagctgttgcaaaccctgcaaacattgtgctgaaaaccaggttttcgacctattacaaagctatgatgccttcaggagcaagctattacgttaagaagcttaactggagtgacaagatattccaattggggagccctgataaatttgagcaagagatagaggctttggggaagcttagcaattcaaatatcatgattccattggcctatgtattgacagttgacagtgcatatctattctatgaattttcccctaagggtaccctttatgatattcttcatgggagcttgaaatcttctttggattgggcaagtcgttacagtatagcagttggagtagctcaagggcttgcatttttgcatggatgcacatcaagtccaattctcctcatagacctttcaagcagaagcatcgtgctcaagtcattgaaggagccacaggttggggacattgagctttgtaaagtaattgacccttccaagagcaacggaagcctttccacagttgctggttctgtaggttatattcctccagagtatgcttatacaatgagggtaacaatggctggaaatgtttatagctttggagttgtattgctggaattgctgacaggaaaagcagcagttagtgagggaactgagttagccaagtgggtattaagcaactcagtgcggccaaataagctggatcacatccttgattttagtatcagtagaacatcactggtggtaagaaatcagatgcttgctgtcttgaaagttgcacttgcttgtgtcagtgttactccagaatcaaggcccaagatgaaaagtgtgctacggatgatcctcaatgtaagataaaatcatctccacctactactgcctttaattaccgagtgagctttgtttcatacaaattataaaagattgaagaaagccaatattggccatggtggctaggaagccaacaacctgcacgaaagaatcgtttggttttgaattcattctcatacgtagtatatgcttttgtaatttaatggtgccattgtaaaactcagttctataataggtgaattctcacataatttcatggttgctagtgatta

SEQ ID NO: 42 - DNA, 814 bp, Gossypium hirsutum
cgatgtaatgaaaatatctccttgcgcaagaatggattgctggactggtttggcttagtcaatgtcatcgattccatgctctagttcttcttggaagattccttgatatgggaccatgggctgtagatctggccccttctgttggaatatttccttatgttctgaagctgttgcaaacaaccactccagaactgcgtcaaatccttgtcttcatttggacaaaaattttgccactccatctgaacgagcaattaatcagggtattgtgccaaagctttgtgtacccacagacactctactgtgggaagatagttttcgtgagagggagaaacccataagtttttctctgccggttctgtttgttgtgacgttgaaatcgcctgcttcatgggtgaatcatttcagactgcgttgtaaaccaagaacgaacgtttcaatcagatcgagtttcgggtttggtgcgcgtcaaacgcgccgtcgcttcggctcccaaagtgtagaaaatcgtcatcaatcgtgatattgaaatccgttcttcatcggattgtgatttcaggtatgagtttcacctcttattttactgtttggtttctgattgaagaaaatcgacagaaatttgtttcaaacttgaaataaatcttwrwwtwtgtaaataattactgatccacctttgagttggcaaattttgtttatcctccattttcccggaagccaaacaggagagttcaatgttctttatttcgaaaattttgtactcttactgtaatattgaacaaattttagttgatcccttgatagaagcttcgaattgtca

SEQ ID NO: 43 - DNA, 649 bp, Gossypium hirsutum
agaaatgtttgaaactggagaaatggtgcactggctatcccataaaagaggcaaacatgaaggaactatcagcttctggattaatgtcaaatcgtggcgggcagatagtatgttcttttcttgttcgtgacatgggaattgactggcgcatgggagcagaatggtttgaaacatgcttttagattacgacccgtgttcaaattacggaaactggacatacggtgcaggagttggaaatgaccctagagaagatcggtattttagcatcccaaaacaagcaaaaacatatgatccagatggagagcacgtggcattttgggtaccagagcttcttcccctccccaaagagaaaaggaattttcctggaaaatcatatattgagcaagttgtacctctcaaatttgggagcagtaataagcaccacagtcaaagaagcaaatatggtgggagacactccgggttaggcaatagatgaaagaattcaactgttggaaacacatttttcatatgctgaaaatctttcaacttgcatcgcatcgggtacaaacaaattttaatttgacaaaaagaatacagatgcctgagaattataaattaagttactagtgaaaaaaacaattggataactataaaatattcttttttaata

SEQ ID NO: 44 - DNA, 224 bp, Gossypium hirsutum
gcaaagaaagaaagtgtttcgatacgtggtctttaagatcaatgagaagaaaaaggaggtagtagttgaaaaaacgggaggtcaatctgagaactatgatgatctcactgcttcattgcccgagaatgattgccgctatgcagtttacgactttgattttgtgacttctgagaattgtcagaagagcaagatcttttttattacatggttagtgtctgtttcaa

SEQ ID NO: 45 - DNA, 756 bp, Gossypium hirsutum
catgaagaagaagatgaacaaggcaccattggcatcgccctctccaaaaatctcatggcagttgccggagaagccttgaaagcaaatatctcaacacttgccccactcgttcttccctggtccgaactgctccttgttgttacttctttggttgcaagaaaattcttcacaaaaaaggtgaaaccctacattccaaatttcaaggtagcattcgagcatttctgcattcatgcaggaggaaaagcagtgttggatgaattgcagaaaagcttgaaccttggtgaatggcaaatggagccatcgaggatgactctttacagattcggcaacacttcgagttcttcattgtggtatgagttggcttattctgaagctaagggaaggatcaacaatggcgatagggtttggcaaatagggtttggatcaggcttcaaatgcaacagtatggtttggaaggcattgaagaacatccatcctttagtggagaagaatccatggatggatgagattcatgatttccctgttattctgcctaaacatgaaccactttcgagttcaactatctaaaccaatcaagcaaattaaataataagcaacttatagacttagcaagatgaactatctaaatgaatcaaactctgtaatgattaaaaataaggtaaattacatatttgtatgtatcatttaaattgaagttttagcccttaaattaaacttgtccatctaaatatgtttttccaattgaatcactaatgt

SEQ ID NO: 46 - DNA, 633 bp, Gossypium hirsutum
tccagcccataggaaatcaaagcgatttgaagttgtgcaacgtagaattcgtcgacctttttttgttgctgaagttgaagccctggttcaagctgttgagaaacttggaactggaagggggggggatgttaaattaagagcttttgataacgggaagccccgaacttacgtagatttaaaggataagtggaaaacacttgttcatacagcgagaatatcgccgcagcaaagggggggagaaccggtgcctcaggagctcctggacagggtcctaactgggcatgcctactggtcacagcagcaagccaagcaacaactgaagcagcaacagcagcctgagagctcccttttcctttataactcaacagtaagagctagtagcagaagtgatggtggtgaaaaaaactttggttgatgatgatgatgggtttttagggaaggatttgtttaattattattttatcattttccttgtatttttttgggattatttaaaagaaaaaaggaaaaaaaattatgccaagaaatatgtaattttttatgtgctctagccctgatttgttttttacaatgtagaggcagggatggcccttttgtaaattgctattgatggaataagagctttgttaaatg

SEQ ID NO: 47 - DNA, 851 bp, Gossypium hirsutum
tcaaatctaccacctacctttcaattctctcctcacatagaccgaacactttctcaccactttatctacatctattgactcgtaggctcttccagcttgtggttctacccctaacttcatctgatctgttattcaccttttatcagaaatgtcgggtaggtcttttttgcggggtactgagagcaaagaaaagctgcttccaaggaaagggtattcggaatttggtttcaacagctcggatgtttccgaggatcgagttaaatgcagctgttttcgatcatgttgtgactcgattgataacttctggagtggattgcaagaactctttgtcaagttatatgaaatgggtcgatcagatccccgtaaggtgatttttgctacgaaaatggggttttcgctaatgtctatatcattgcttatgcttttcaaagagcctctaaaggaaactagtcaatattctatctgggcaattcttactgtagtcgtggttttcgaattcagcgtaggtgcaacacttaacaaagggttcaatcgagctatagggactttctctgctggagcccttgctttaggcattgcacaagtatcaacattgtctgggaagtatgaagaaattattattttgataagcattttcatagcaggattcgctgctagctattgcaaattgtaccctcccttgaagacatatgaatatggttttcgggtattcttgttgacattttgtattgtactggtgtctgggaacaactcaagaaccttcttcagaactgctttttaccggttgttgcttatcttcattggtgctggcctgtgtttgattataaatatatgtatataccccatatggt

SEQ ID NO: 48 - DNA, 1160 bp, Gossypium hirsutum
cagtagcccacaaacatgtgtaccgttcccttttatttaatcctgcaacaatggataactaatgcttcgcttagaggtaggttcataggggcaaaamswaaaaatgtcatcagctgctgtaggaactttctcggcatccaaacagattggtttcaacaaaaacgaaaccaaagctggcgaagaagaagagttaagagatgagaaaaacaagaaattcattgatgataatgatgaagaagctatcaacaatggtggtaaaccccatgatgatcaacatgatgaagaagaagaagatgatgatgatgatgatgccaagttgaaatccgagaaagaattggatcttggtcctcaattttccctcaaagaacagcttgaaaaagacaaggatgacgaaagtttaaggagatggaaagaacaacttcttggtagtgttgatatgtctgcggtcggagagagtaaagagcctgaagttaagatattaagcctctcgatcgtatcccctggtagaccagacataattttgccaatcccatttgttacaaagcctaaaacttgtctgtttactctaaaagaaggaagtcgatttcgtctcaaattcaccttcaatgtctccaacaacattgtctctggtcttaaatacgtaaacactgtttggaaaactggtattcgagtggacaacacaaagataatgttggggacatttagtccacaaaaggaaccttatacatttgaattggaagaagaaactacaccttcaggcttgtttgctagaggctcatatgctgtaaggaccaagtttgtagatgatgatgacaaagtctatttggatgtgagttatcactttgaaatccagaagaactggggttcacgtccttgaaggaaaattwaagggaaaaaaatgcaattaatccacttttttattttatttgtgcttgattgttgggttttttttcttctaaawatctcttgtagattctgttttatattattattttctwtctgattgtctatstgtctacatatcatgkcttccacattccctttaytgaggtggcaaaatagtmcyttaaaaaatggtaaattttkctctcagtccatgtrcwatgtacacatttgaaatcyartccayttaattktaatttcaagaattcaacccttct

SEQ ID NO: 49 - DNA, 835 bp, Gossypium hirsutum
caagttttggcatcaatgttgttggagaaagcaaaacacgagcatgagggtcacgttctaaagcaataccgatccaaagccgagtactacctatgctcgtgtctcaacaaaaacaacgccaccagcgacaacgtcgaacgtacccctggaggtcttttatacatccggcaatggaacaacatgcaatatgtgtcgacagcgacattcctactcactgtctactctgactttctccgcaactcaaagcaacacctccggtgtcccaccggaacaattgataccgaagagatcctaagttttgccaaatctcaagtagattacatactagggtctaaccctatgaacatgagttacttagtgggctatggttctaagtaccctattagggtgcaccatagaggtgcctccatagtatcatacagagaaaacaaagggttcattggttgcacccaaggctatgacaattggtatagtcgagtggagccgaaccccaatgtgttggttggagcattggtcggtggaccagattgtcgagataatttcatggaccaaagagataattatatgcagaccgaggcctgcacatacaatacagcaccattagttggggtttttgcaagattgttgcaattagaggaaaaccttgaagtagaattggttgcctcttattagatatacaaaatataatcaaatgatattatatagtgttggtggtgagtattttaagacacccttttttttgtgtggctgaactaaaaggtgttcaatgccactaactatttcaccttcaattttgttgaatgtttataatagtgaaaaaaatataatgttcgat

SEQ ID NO: 50 - DNA, 791 bp, Gossypium hirsutum
gttcgctgataaatttaagttcggaaatttgtccgatgaagtggcttatatatttgccaaggcagtacaagttgcatcaggtgtagtttttgttggaacagtttttgccttattcaaagctatctcttggcatcgaagcaagagcaccagtagttgtttgtcacttgtatctccttctaaaggaactaaaaatcaacctaacctaacaaagcgtcagctggggcttttaggagtaaaatcgaaggttgagcaagttgcaccggattcttctaagaaacctcccaagtccaaacccctggcagcattatcttcttcggatgttcttgtaccacttcatccatcaattagtggctcagatcgtaagtctctagctagctctaataaatcaaataccagtggtggaaataagatgagcccttttgctacaccatccagatcccagggctccccttcttcattatatcttgttccggcatccacttcgtcattatcttctcgtcaaacttcaccgggacaagagcctctagtgaaaaccccatggtccactaagcgatcctcctatgccaaagaaattacaacagaagagcaacttgaacagtttcttgccgaagtagatgagaaaatcaccgaatcagcaggaaaactagctaccccaccaccaaccatcagtggatttggaatagctagtccgaatactgttgcaagttcagctaatacatctggaactacaagaagtacaccactgaggcctgtgaggatgtctcccgggttcccaaaaatttaccactcct

SEQ ID NO: 51 - DNA, 643 bp, Gossypium hirsutum
taaatggaacccacaagtctcatgttcattccccttatgaggctgcaatacttgctagttacaagcctgtagtcaatgtcacaacgctgattccaagcctaaggcaggtcgaagagacaactaagaaaggtttggagtacttcaaaagcacacggcacatcattctttactatgaggatgtagtaaagaacccccctaagttagccgaggtccaagaattcctaaaggttccaaagagggagttgaagagtcgtcaagtaaagatacccaagggatcgttatccaatcccattcagaattgggttgatgttgaaaaggcactcaatggaactaagtatgaaagttatttacatgcagattacaggaagtaaagcagtggcattgatgtacattccatttttgacccatttccactcttcctttgtttcggatctccaagtgacaggcaccaacagtgaacctaccaagctgaactctgttcggattttgggtacccggcatgcatcattttgcttttaaattttacccttacactcacgccttggtattcttttcattcttttgtttttcagttgatatagctttgacagaaaactgctgtatttatgcccaatcaaaggagaaacttccctgtttgcgttgt

SEQ ID NO: 52 - DNA, 485 bp, Gossypium hirsutum
gcgcggaccaaaaaaaaaagattaaaattgcaaaagtagtggcatgaaagcaggtgtgttattggcaacacatgaatgaattattcctttcattggcattgctttttgctcacaccacttgcttctcctccttactcatctcagcatggcctcaaaacccttcatcgcattagccaccactgttctcttcttctccctcatcgccgtcaatcattttgggaaacctttccacggcaaacttggggaaatggaaattgtcccaattacggatgccgtaggacctgaaagtgtagcatttcacccacttggagacggtccctacgtcggaatatctgacggtcggattatcaagtggcaaccaaatgagcatcggtggatcagttttggcatcacttctcctaacagagaagggtgtgaagggacagacgatcatgaaacaagggaacacacatgtggacgtccattaggcatatgcttccacgaga

SEQ ID NO: 53 - DNA, 752 bp, Gossypium hirsutum
ttgatccaatatcctcccccagatttatccagtgcgacccaaacacgatatattgcaatgtacgaatacacaagcgacaccgacgaaccgacgcatctctacatcaatgggaaaccgtacgaggcgccggcaacggagacgccgaaggcagggacgagtgagatctggaacgtaattaatttaacggaagataatcatccgattcacattcatttggcagtgtttacggtgttggatcaaacggagctagtaaaagcagaggagtttaaggcctgcatgtcgaaaatgaacgacgccatcaagtgccaaataagcaaacacgcacgtggcaaaaagttaagggtggcagctcatgagaaagggtggaagaatgtgtataagatgacacctggatatgtgacaaggatattagttaggttttcttacatacattccaacacttcatactcatttgatccaactggaatgcccggttacgtgtatcattgtcatatcttggatcacgaagacaatgcgatgatgaggccacttgtggtgatgaagtgagaagcaatattggaaggaagaagagcaaggtataacaggaaatgggcattgtaaagtggttaattttgttctgaaagtactggtacaagcagggggaagttagacatatgtatagaaccagaatgttaaaagtgtagaattggttaaaaacaaaatggatgtatctttatgatctagaaatgtaaggttgccaaagtgtggtttgc

SEQ ID NO: 54 - DNA, 841 bp, Gossypium hirsutum
tctctattgtccttcactcccaacatttgagaaacaagcaaagaaagatggccaatcttagatgtctcacaaaacatttcatatgtgcttgtcagcttctctttttattgcaagccgaagtcttttgttctcagtacaaggttggagatttagatgcttggggcattccaacatcagcaaatccccaagtatatgccaaatggtccaaaaaccattccttcaagctcggagactctctcttgttcctatacccaccaagtcaagattcagtgatccaagtgacggaacaatcctacaacagttgtgacctcaaagatccaatcttgtacatgaacaatggcaactcactgttcaacatcactaagcctggggagtatttcttcaccagtggggagcctggtcactgtgaaaagaagcagaagctgtacatcgctgtgctttcaggcaacggctctgcagcacttgctccttcttacggtccttctgcattaccggacactgcatcgtcaccgtcttacacgactgtcttcggcaacatccctcaaccgccttcttcatcgccgtcactagggttcccattattcgttacagctgttgttgcatcagccacatggggaataatcaatgccatgatatgaagaaggggacatagttactcgatctctactgtcaaattgtcaarccattccatttggcattttatttatttttcattcaaatgttatttctagaatttgggttttattcttcggatttgtgattcatttttcggtgatgaaacttgcaaagagaatacgaacagtgaaatgggagatctagacagtattgtattgtattgtat

SEQ ID NO: 55 - DNA, 893 bp, Gossypium hirsutum
gctagattattcaatgaagctgctcagatgtctcctgaggatgctgatgtacacattgttcttggtgttctgtatgatttgtcgagagaatatgataaggccattgcatctttcaaaactgctttgaaacttaaacctaatgattattctctttggaacaagcttggtgcaacacaagccagtgtgcagagtgctgatgcaattatcaacaggcactagatttgaagccaaactatgtgtatgcttgggcaaacatggggatcagttacgccaaccagatgaagacaggatgtgtggccctagttttatgtctaaatatcagtgttgatccacccgatgtaataaaaatatctccttgcgcaagaatggagtgctggactggtttggcttagtcaatgtcatcgattccatgctctagttcttcttggaagattccttgatatgggaccatgggctgtagatctggtagttctttagggccccttctgttggaatatttccttatgttctgaagctgttgcaaacaaccactccagaactgcgtcaaatccttgtcttcatttggacaaaaattttgccactccatctgaacgagcaattaatcagggtattgtgccaaagctttgtgtacccacagacactctactgtgggaagatagttttcgtgagagggagaaacccataagtttttctctgccggttctgtttgttgtgatgttgaaatcgcctgcttcatgggtgaatcatttcagaacgaacgtttcaatcagatcgagtttcggggtttggtgagcgtcaaacgcgccgtcgcttcggctcccaaagtgtagaaaatcgtcatcaatcgtgatattgaaatcccgttcttcatcggattgtgatttcacgtatga

SEQ ID NO: 56 - DNA, 1213 bp, Gossypium hirsutum
caagcaaccactcatcttcatcaccattcaacaaattccccaaatccttttccactattttcccatctgcaacatcagctttcactacatacgcttcaataagtgcttcattaatgcttttacgatccatattcaacgatctcatcccatacccacttcgaaaacacatattctcagctatcagtcctttattctgtttcttctccggaaagcaaaccatcatcatcgaccaatccgacggcatcgaaccgaaccatgttttcaacgctaccgagctttatttaagcaccaaaatcaacccaaatascaaaagactcaaagtaagcaaacggatcaaagacaaagggttatcatktaagctygataaaggtcaaagaatcacagattccttcaatggtstcgagcttaaatggcgacatgtttgctacgragtggagawaaaaggtaacgttactgaaaaacgatayttcatgctaagattcaagaaaaataatggggatttagtgatgaattcttatttgccatttgtgttgaaatctgctgaaatgatcgaaaatgaaatgagggttttgaagatacatacattggggaatgttcrttatggttytaaattcaaatgggaatcgattaagcttgaacacccatcgacatttgagactttagcacttgacccagaattgaaaaccatgaytrttgatgatwtaaacaggtttattagaaggaaagagttttataaaaaagtgggtcgatcatggaagaggggttwtttgttgtatggaccacctgggactggtaaatcaagyttggttgctgctatggctaattatttgaagtttgatatttatgatttgcagcttgagaatataaaagtgattcggatttgaggagattgttgcttgatatcgggatagatcgatctgtgatgaagatattgattgtactgtaatttgcctgatcgtggacataggcgtaatggtcaagacaaacagttgacgctttcggggctattgaactttgtcgacggtctatggtcgagttgcggagacgagaggatcatcgtgctaacgacgaaccacaagcataggctcgatccggctttgttacgtcccggaaggatggacttgcacattcacttgtcatattgatgtatgcgtgctttcacgcttttggctgcgaactacttggggatcaaaggcgagcaccggcttttcgg

SEQ ID NO: 57 - DNA, 967 bp, Gossypium hirsutum
gtagtgagagatcttaaagttgaaacgaaccctcttttacacgctgtttctctttctctcatattcatcactcgaagcaaagtaaaagggaaagtaaaaggagggttttgaggagagtgaaagatggctggttacagggcagaggatgactacgacttccttttcaaggtggtgctgatcggtgattcgggagtaggcaagtctaaccttctctcaaggttcaccaggaacgagtttagcctcgagtccaagtccactattggcgttgagttcgctactcgtagcttgaatgttgatggtaaggtcatcaaggctcagatttgggacactgctggtcaagaaaggtaccgtgccatcacaagtgcctattaccgaggagctgttggtgcgctacttgtgtacgatgtgacccgacactccacgtttgaaaatgtggagaggtggttaagagagttgagggatcacacggatcccaacatcgtggtcatgctcataggcaacaaatcagatctccgacaccttgtggctgtcccaactgaggatgcaaaatcctttgcggagaaagaatccctctacttcatggaaacttcagccctggaagcaacaaacgtggaaaacgcatttgcagaagtgctgacacagatctatcacatagtaagcaagaaggcaatggagacaagtgatgaaggggctgcttcagctgttccatccaagggggagaaaattgatgtcagtaaagacgtgtctgcaataaagaaagggggttgctgctcgagctaagggatgaagaagatgttaaaacctgcagtctctgattgttttaagggatgcaggcatggatggggatttcattgtaaaccttgggttctgtaaaatttttctcaaaaaggtaccctatagtaggatatgggtggactggagattgatttaatttacataaaaaaaaattcataatggctgttaattt

SEQ ID NO: 58 - DNA, 1953 bp, Gossypium hirsutum
gcggggacccacacctctttttcttatcttcttaattatttctctatctcttgcaatatgcctccagcctcgcccgatttctccagctctgtcaagcttaagtatgttaagcttggctaccaatacgttgtggatcattttcttactctcttgttggttcctgtcatggttggtatccttattgaagttgttcgtttaggccctcaagagattgttaacctatggaactccctccattttgatcttattcagatattgtgctcttctttcttcatcatttttattgccactgtttacttcatgtccaagccacgatgcatctaccttgtggattatgcatgctacaagcctcctgtgacttgcagggttccttttgctactttcatggagcactccaggttgattttgagcaacaatcctaagagcgtggagttccagatgaggattctggaacggtctgggctgggtgaagagacttgtttgcctcctgctattcattacatccctccaaagccaaccatggaggccgctagaggcgaggctgaggttgttattttctcagctatggattcgttgttcaagaaaacggggctgaaacctaaagacatagatattcttattgtcaactgcagtctcttctcccccacgccatctttgtctgctatggtgatcaacaaatacaagctgaggagtaacattaagagctttaatctttcgggaatggggtgcagtgcggggcttatctccattgatttagctcgggatcttctccaagtacacccgaattctaatgcagttgttgtcagcacagagatcatcactcccaactactaccaggggaatgaaagagctatgctccttcccaactgtctcttccgcatgggtggcgcagcaatcctgttgtcgaaccgccgctcagagaggcggagagccaagtaccgacttgtccacgttgttcgaacccacaaaggggccgatgacaaggcctaccgatgcgtgtttgaagaagaagacaaagacggcaaagttgggatatcattatctaaagatctcatggctatagctggagaggctttaaaatccaacattaccacaatagggcctttggtgcttccagggtcggaacaactcctatttcttctcactctgatcgggcgtaaagtcttcaaccccaagtggaagccttatatcccagacttcaagctggcgtttgagcacttctgcatccatgctggagggcgagcagtgatagatgaactgcaaaagaacctgcagctgtcagcagaacacgtagaggcatccaggatgacattgcacagattcggaaacacctcctcctcatccttgtggtacgagatgagctaccttgaggcaaaagggaggatgaaaaagggagataggatttggcagattgcttttgggagtggattcaagtgtaacagtgcggtatggaagtgcaatcgaaccatcaaaaaaccaacagatgggccttgggaggattgcatccataggtatcccgttcatatccctgaagttgtcaagctctagacagcttcttcattcatggccttccttctttgcctttagtactttgctaaaatcatcatcatcatcatcatcatctacttcttatcctactccatctctgcctttatatttctcctctgtatttttcttagctcctactcatttgtctctcctcttccttttccattttctcttttcaagtcatgaattcacatagataccaaatatgatcacatttatgtgttgactaaatgtatcccttgcaagggaatgaaaaaacagtgtggaaacaggttggattagctccttgaaataaacctggaatatttaacagaaaatgctatatatgtgcttgattgtacaaagaaaaaaaaaagaaagttatagctaaatttgtccatcataataatagtctttttttccctc

SEQ ID NO: 59 - DNA, 1708 bp, Gossypium hirsutum
acaaaatccccttccatttctcacaaaaccatgaagaagaacaaccacctttctcctccactaccatggacgacccctttcattattctttcaatcctgaccgtccattccatcaagatcacttcagccgcttgccatgtggatgatgaaaaaggcctcttagccttcaaatcgggtatcacccaggatccgtcaggcatgctcagttcatggaaatcgggtacggattgttgtaattgggcgggtataaattgccgtgaaaacaatcgggtcaccactatttctctttacgggcaagttgataaacccgacagctacttgacgggtactatctcttcttcccttgtaaaagtccaaaatctagacggtatttactttgttaacctaaggaatatttcgggtccttttccggatcttcttttcgggttacccaaactcttatatgtttacattgagaacagtaagctttcgggatccttacctgtgaatattggtaagttaaaacaacttggggccttgagtcttgaagggaatcggttcactggatccataccgagttctatctctgagttgactcagttaactcagttggttcttgggaaaaatgaattctccggtcatttcccggcggggattaaacagattaggaaccttagttacctgagtttagaacaaaacaagctgatgggtaccattccggatattttcaaatcgttcaccgaccttagaattcttagactttcccataatgaattttcggggaaaatcccagaatcaatattgtctttggcaccgaaattggcgtaccttgagttgggccataatcgtctgtcagggcaaataccgagttatctcggaaagttcaaagcattggacactttagatctttcatggaattcattcactggggtagtacctaaaacattttcaaacttaaccaaaattttcaacttggacctttctcacaattctctaaacgacccatttccccaaatgaatgtgaaaggcattgaatcactggatttatcgtataacaatttccatctcaaagaaatcccaaaatgggtcacttcatctccgatcatatattcactcaagctagcaaagtgtgggattaaaatgaacttagacacttggaagccagcggaaacttacttttatgactacattgatttatcggagaatgagataacaggtagcccagttgatttattgaatcgaacggatttcttggtggaatttaaggccgccgggaataagttgaagttcgatttggggaaattgagaatcgttaaaacactgaaagagttggatatatcacggaatttggtgtacggcaaggttcctgcggcgattaatgggttcaataaattgaatgtgagttataaccatctgtgcgggcagcttcccaagaacaaatttcctgtttcttcatttgtgggaaatgattgtttgtgtggacctccattatcgccttgtaaactgtagctggttaacaagtgtttgtggaaatgtcactgaggttaatataatcaataaaagtgtttgtgaaaatgtcaccgtgagttataaagatcaataaaattttggtgctactgcttttttaagctaaaatttctgtatttgatgtgtactcctcttgcctttggcaagaacagaaatattgaataacatttagtgtttcgtcatttttggtcgacgcggccgc

SEQ ID NO: 60 - DNA, 2787 bp, Gossypium hirsutum
atgctaaagaggctccccgtaaaagtgaggctcctttcgttacttatagtagcaacgccgctccaaccccaaagaataaaaggttcttctactggtatatataacaatggtagaacctcggcgtttactcatgatattctttttgtcgacgttgttgattgcttatagcaatgcaaatgtcgaagagattcagaaggataccgaggaaggggacgaagaaggtaaggtaggaggtcagaaggctcagggcgtgacatatgacgcaaggtccttgatcatcaatggcaaacgagagcttctcttttcgggagctatccattacccacgtagcaccccagatatgtggccggacctgattaaaaaagctaagcagggaggcatcaatacgattgagacgtatgttttctggaatggacacgaaccagttgagggacagtacaactttgaaggagaatttgacttggtgaagttcatcaagttgattcatgagcataagttgtatgcagtcgttagggttggcccctttatccaggctgaatggaatcacggaggattaccatattggttaagagaggtccccgacatcattttccgatccgataatgaacctttcaagaaacacatgaaaaggtttgtgaccatgattgttgacaaactgaagcaagagaagttgtttgctccacaaggaggacctattattttagcacagatcgagaatgaatacaacactattcaacgagcattcagggaaaaaggggatagttatgttcaatgggctggaaaactggcccttagcttgaatgccaatgtcccatggatcatgtgcaagcagagggatgccccagatcccgttatcaatacatgcaatggaaggcactgtggagatactttctatggtccaaataagcgcaacaagccggcattgtggactgagaactggactgcacagtatagagtattcggtgatccaccatcccaaaggtcagctgaagatttggcatactcagttgctcgattcttctccaaaaatggaagcatggtcaactactatatgtactatggtggcaccaattttggcaggacaagtgcctcatttacaacaactcgttactatgacgaagcccctcttgatgaatttggtcttcaaagggaaccaaagtggggtcatcttaaggacgtccacagggccttgagtttgtgcaaaagggctctattttggggggttcctactactctaaagttgggtccagatcaacaggctatagtctggcaacaacctggaacttcagcctgtgcggctttcttggccaacaataacactcgtctggcacaacatgtgaatttcaggggccaggacattcgcctgccggctcgttccattagcgtcctccctgattgcaagaccgtggttttcaacactcaactggtcacaactcaacataactcaagaaactttgtaagatcagaaattgcaaacaagaactttaactgggagatgtacagggaagtccctcctgtcggacttggatttaagtttgacgtgccaagggagctttttcatttgaccaaagatacaaccgactatgcttggtacacaactagccttttgttgggtcggcgtgatttaccaatgaagaaaaatgtccgaccagttttacgggttgctagtcttggccatggaatccatgcctatgtaaatggtgaatacgccggttctgcacatgggagcaaagttgagaagagctttgttttgcagagagctgtaagcttgaaggaaggggaaaaccatattgctctcttgggctacttagtgggactccctgatagcggagcctacatggagaaaaggttcgctgggcctcgttctatcaccatccttggtttgaacactggaacactggacatatcacaaaatggttggggccaccaggttggaattgatggagaaaagaagaaattgtttactgaggaaggctcaaagtctgttcagtggacaaagcctgaccaaggaggaccattaacatggtacaagggatattttgatgcaccagaaggggacaacccagttgccattgttatgactggtatggggaagggtatggtttggatcaatggtagaagcattggccgatattggaacaattaccttagtcctcttaagaagccaacacaatccgagtaccacatcccacgggcatacttgaagccaaagaacctgattgtcctccttgaggaagaaggaggcaatcctaaagatgtccatatagtaacagtcaacagggatacaatctgcagtggtgtgagtgaaattcacccaccatccccgagattgttcgaaaccaaaaatggtagtctccaagccaaagtgaatgatttgaaaccaagggctgaattgaaatgtccaggcaagaagcaaatcgtggcagtggagtttgcgagctatggtgatccatttggcgcttgcggagcctactttattggaaattgcacagcgccagaatccaagcaagtcgttgagaagtattgcttggggaagcccagctgccaaatcccactagatagcattcctttcagtaaccaaaatgacgcatgtatccatctcaggaagactttggccgtccaactcaaatgtgcctaaacaaatgcgtgcttcgacacagcttggattaagcttcacattttattttttttaattgagctaagacggtgcatggaggagtgctcgatctatttaatttgtatttcttaaatattaaatgaatatgtgcgaattccagaattacaata

SEQ ID NO: 61 - DNA, 1590 bp, Gossypium hirsutum
ccgcctactgctgtaggcatcattcaataaacttcctccaacgtcctttactgtttcttcttgtattccagtttctccattgccaaactctccctcaaagctcaatcacttttttctttttcgttcaaacgacagaaatgaagagtttgagtccttcaaataatttatatttcttcctcctccatttttttattatcacagtttatttcgcctcattgtctttcggtctcaagatcggggaaacatgttcttcttctggtagtagtagttcatgcgactccggcttaacatgtcaaacttgcgccgcaaatggaaatacccgacccagatgcactcggattcaaccactcagccctacatcaaaggtaaaaggtttgccatttaacaaatattcttggctcacaactcacaactcttttgcactcaaaggggtaaagtctgaaactggatcttctattattgcacccactaaccaggaagacaccatcaccaatcaacttaagaatggggttcgtggacttatgctggatatgtatgacttcaacggtgatatatggttatgtcattcctttggtggccaatgcttcaatgccacagcatttcaacctgccattaatgtgctcaaagagatacaggcgtttctagaggcaaatccatctgagattatcaccatatttattgaggattatgtggtatccccacaaggcttaacaaaggttttcaatgcatctggtttgaggcagtactggttccctgtttcaaagatgcctaagaatggtgaagattggcccacagtggacgaaatggtcaagcagaaccaacgacttgtagttttcacttccaaatcagctaaagaggcttctgaggggattgcttatgaatggagatatgttgtagaaaaccaatatggagatgatgggatgaaggctggttcctgcccaaaccgtgctgagtcatctcctatgaatacaaaatcaagatcattgattcttcaaaactattttcctactaatccgaacgagacagcagcttgcgcagaaaattcagctccactggtaaagatgctggacacttgtcataaagcagctggagatcgctggccaaacttcattgctgttgatttttaccagaggaatgatggtggaggagcctcggaagctttagatgtcgccaatggtcatctcacttgtggctgtgacaatatagcctattgcaaggccaatgctacatccggcacctgtgaagtccctccaatgtcacctcctccaccggctgccaccactcaaaccaccacagaaaatccttcagcgtctaactccaacattgctaacacggatgccagacctctccaattgcggtggttattggccacaattttgaccaaactcctattgttacagttatggtaaatcaccagtttgcctgtttaaaatttatttttagtttgtaagattcgagtcacacggctgttgtttcacagagcaactcctgagcgtcttctttaggttcttgttgttaatgcacctctgcttctcatttgttatataaaataatattaatatattgctccaatttcatttgacattttta

SEQ ID NO: 62 - DNA, 1782 bp, Gossypium hirsutum
cttactaaactatttggattttggttctctacccaaattcagacaagcaaccggaaaaaagtgtcagttgtttcagttttcagacaaggaaacaaagcagaaaaatcgggtcagaaaaaaaaatgagaattaactggaaatcatggtcactgaacaaggaccatcttgtgaagcttgcaattggcattctcttagtgggttttgcttgtaagctcttggtttttcgttctaaaggatttggtgctgatttggaattccctgaggtagagaaagagtatgttcaaaaaccagatttggaacctcctgtccctgttcaaatacctgaaaatgatgatcaaatgcctctagatgttgttatagagaaatgtgatctctttacaggggattgggttcccaatccctcaggtccgacctataccaacgagagctgtcccttgatagaaggtcatcagaattgtatgaggaacggccgtcctgattccgggtatctacactggaaatggaagccgcgtgactgtcagttacctcgttttaatgcggagagatttctggagttgacgaggaataaagcatgggctttgatcggtgattccatatctcgtaaccatgtgcagtcattgttgtgcatgctcgcaacggttgaacggcctgttgaagtttaccatgatgagcagtacaaatcaaagagatggcattttgcatcatacaattttaccgtttcaaacatttggtctccttttcttgtaaaggctgctgttttcgaagataatgacggtgtttctacagctgaagttcagcttcatctggacaaacttgataagacatggacagatctctacccaagcctagattacatgataatctcgactgggaaatggtttctcaaggctgcaatctaccatgagaatgacaccgaagttggctgccatatatgtccaggaaagaacctgaccgaattaggatttgtttatgcttacaacaaaacactccattatgtcatggacttcattgcaaactcaaagcataaggggttgatctttttcaggacatccacgccggatcattttgagaacggagaatggcataacggagggagttgtccgaagacaaccccggctaaagaaggagaagttgaaataaaagacttgagccgaattctgcgtaacgttgaattagaagagtttgagaaggcagctgcaaaagccgctaacaatggggtgaatcttaagcttcttgacttcacaaacctcttattaatgagaccagatgggcatccgggtccataccggcagtttcagccgtttgcagagaaccaaacagccgtggttcaaaacgactgtctacattggtgtttacctggaccaatggacttttggaatgatgtgattatggagatggtggtcaggggttaaattattaaaaagggagaagttctgagcaatttttggaggttggtttttctcagaaattttgacaatggcaagcctgaagctatttcatcagattgaaaagtagataaactatacttgtctgtaattcatttcttggattggcaattgtaacttgattctaaaactctatgattggagatttgctattagtgtatagataaataatctgcaaacttgtacctatatgcaatttattgcattttccatacaaccatgcccccataagtgctttgctgaatttggaattgagaaggcttaggttttacagcaatgaaaagattgtgatttatgggtattgaatttagaaatttttaattggattcaagagtta

SEQ ID NO: 63 - DNA, 1317 bp, Gossypium hirsutum
  misc_feature (11)..(11): n is a, c, g, or t
gtcgtcacacntggaagcccttccttctctctttgattatcgattaaaaagaaaacacagatggaagatattaaaccattaattgaagctttgaagactaaattaaagcaagctttgattctatgggcagagggtttcagagaagcttgttgtcttcacagagttatcgttctttgtcgcaggtcgaagaagcttatgattagaacgggacagtgttttcttttaaatggcttcatattcttaggaagtttgtttgtcctaaattcagtagttatcccaacactacaatggatattgcctgatcattactcacaaaccagttgtgaagcaatgtctgaattccatggtgtcttcaaattttattccttcttacgtggcttcctcatacaactattctatgtattttggttctatcccttatatgtattcagctttattctgagcaatctatggtacaatgacattgctacacatggttttgctgcaatggggagatccaggccttctacggtggaatccttgaaacaaaacgatacgttgacctcagacagcaaagtgcatgcagctaggcctgctggcctcggaaggatcatgattggaataggggagcaggtgtattcgttgcttcttttaactttctttttcttcgaggtttatgccacaggatttataccttacattgggaaggcactcaattttgtacttctttcttggatgtacgcgtattactgtttcgagtacaaatggaactttactgaatggggcctggagaaaagattggatttttttgaaactaattgggcattttttgctggtttcggaagtccttgtgttctagcgattttctttttcccacctctcgtgggatatgggtttatggctgtactcttccctctgtttgttcttactgcaacaggcacagaagccgagcaggttatttccactcgaagaagaagattaccggtgcacaattggggaaggttccagtattttacgcagctgacactttattgatgcgggtcttgtccctcttcccatcggaatcccgagaacgaacacaagacaacaaaacactataacagattctgaccatgctctcctaccttcttgacctgtaagtccatttccacaagctcgaccgaaaaaaaagacgcttccgaacttttttatctcatttcttttgtatctttgtgttgtgtacataaaaatttgcagaaatgaagtgtaaaaacattatacttatcattgatttctgcccctcttatgagattaccaaaaatgtgggttttatataaacttttaaagttatcttaaaaa

SEQ ID NO: 64 - DNA, 783 bp, Gossypium hirsutum
aaaaaaaagaaaaactccaracaaagccaatcaatcacccccttccatcaatatagccatttttctcatcayctccacacataaacgcacacaaaatgaacacccattctctcaaacttctcctwattctmctcacaatcactttcccrtcaacccaatgtgatgatgatcttgtagaccaaatatgcaaaaaaacacccttctatgacctatgtatctccacyttaaaatccaattccaatggsaragacgtgaaaggtttagccagtgtaatggcygacaccatgttgtctaacgccaccgacacattgagctacatccgagccgaaataaaccgaaccccagatcctaaaattgagagggcattagcttattgtgccgagctttatataccggtggtgaartataatcttccacaagccattgatgctttgagtaaagggcagttcgagttcgccgccgatgggatatcggatgcggctaaagaagcagattcttgtgagaagatgatttcgtggtcgcaggaattggcggcgttgagtgatcggaataagttgattcatarcttatctgatgtggccgtcgccattgttaagattttgcttaaaggttratggamtttgaaactgtgggggattttggtgacgagttgcttgtgtgtaatttagttttctggctgtgaatttttttatattctgtctggggtttgggagtgttgttgtcatttacgtgttgagaaaaaaattcaaccgtagatttagcatcttttatttttcctttttg

SEQ ID NO: 65 - DNA, 959 bp, Gossypium hirsutum
attaaactgataatcactggatccgccaagcttcaaatggcaacccagttgcctgatttcatgctgatcttcgtcatcagttgcctaggtttcatctccctttgtaaaccaatcctcggtttcatcaaatgggtgtgggtcatgttcctcaggccgccaaagaatctcaagcaccactacggttcatgggccatagtcaccggctgcaccgatgggatcgggacagccctggcgttccaactggcatccaagggtcttaacttggtcttggtggggcgaaaccctttgaaacttgtagcaaccgccgatgccatacgtgaaaatttcggcgcacaagttgggaccagaaacgtcgtcattgacttggcgaaaaccagcggagaagagatatcaaagacgatggaggatgctattgaagggctagacattggcgtactggtgaacaacgccggcttggcctacgagggagcgaggttcttacacgaggtggattcggaggtggcggagagcattataaaggtgaatatagtggcggcgacttggattactaaagcagtggttccgattatggcgaagaagaagaagggggccattgttaacgttcggtctggttcttatggcggcttctgttcttaccctttatacaccatttatgctgctacgaaagcataccttacaatgttttcaagaagcatcaacttggaatacaagaaaattggaattgatattcagtgtcaggttccattgttcgtggccaccaaaatgacgaaatttaagacatcttcattgttcatcccatcagccgagatgtttagcaaagcaagcttacgatgggttggccatgatgagcatctgtgtgtaccttattggcctcattctttgcagtgtttcgtattgaatgcattgcccggatagcttgaagatccatatattttccattacttttctacggatgcgta

SEQ ID NO: 66 - DNA, 1167 bp, Gossypium hirsutum
ctcttcactaaacaatccactgcttctcacttgctttcttttcttttctttttactggacttctcaaagcattccccaatttcctccctgtttccagctctagtttccaagcagtttcagaggaaagaaagtaaagcctctttactgaagatggaaagccccatcacttcaaaatgctgcaaccatcagccctggtttgtcttacttgtctttttcgttttctgtattgagctattttcctttgattactctggtttaactgctaaaaaatctgccctcgtcactgttttggatgataatcatggaaatgtaatcaatacccaaagttctttacctcatggtttcactgaaattaccaatgctacgtctmtccattgcccaaaactgatgaaaagggagatttgaaagtgggaactgagatcgattcttgtgtgggkagatatatatttgttcatgatcttcccagtagatttaatgaggatttggttaacaattgtcgrttgctcactaggggaactgataaaaacatgtgtccatacttggacaacttgggttttggtcctgaaattgagaaccctgaagatgttttgataaacaatagctggtttttaacgaatcagttcttgttggaagtcatctttcacaataagatgaaaaggtatgaatgtttaaccaatgactcgtcgattgcatcggctatttacgtacccttttatgctggtcttgatatgagcttgtatctatggggtttcaacactactgtgagagattctgcatctcttggccttgttaagtggctatcagagaagcctgaatggaaaagaatgtggggtagggatcatttcttagttgctgggaggattgcttgggatttccgaagacaaagcgataacgaaaccgattggggcagcaagcttcggttcttgcctgaatcaagaacatgtcgatgttgtctatcgaatcgagctctgaamaatgatwwtgcatcatatccaacatgtttccatcctwcaaggaagtgagawtttcrtggcmgkatcgaatraaagccaaaccgccgaactttctctcggggcccctgagctggaatagaatcgattcgggcgggaatacgatctcacgcgctgagctcaaagacagcaagtcggttgaatgatggtggccaac

SEQ ID NO: 67 - DNA, 937 bp, Gossypium hirsutum
cttttagttgttcatcaattaagcaagcttatakattccagcyatggcggaaaagaaatggattctgatactttttttaactttcatcattgcagtgtctcaagttcaccatttatacatgggggaactagcaagcataatgcttgaaaagcttcaacaatggcggaaaccattcaacaatggtggaaagaacttagcaattggacctaacttaacagcttgtcattcatcgtacggtcgaccrgatcttctsgtttattgttgtccaccggggtttcagactccagtaccctttaccgattttaagttccctgacccatcaccggtccgggtccgacgaccggcgcatcttttaaacgaaagttttatagctaaatataataaagctttatcaataatgaagtcactaccatacgatgatccacgaagctttctccggcaagctaatttacactgtcagttctgtaccggcgcttacgagatgttgaaccgttccggctcggagctgaacatccaccgtacgtggatgttctttccctggcaccggatgatgatatactttcacgaacgaatccttggtagcctcatcggagacgatactttcgcgttgccgttttgggcttgggatatcccggacggaatgacgataccggacttttacgtagacragagctcgccattttttcacagccagcgcgatttctctcattttccacctcgggtggcrgatttagattatagcacygatgataacgatccacgttttgatgggaaagaacaaacggaaaccaatttggcttttatgtataatcgaatggtgtccggcgctagaaaacggagctgttcatgggatgtacatataaagccgcgacagactgtgatcgccggaactatagagagtgcacctcatatacttacatacatggatcgggtcggg

SEQ ID NO: 68 - DNA, 2399 bp, Gossypium hirsutum
gcgggggacccaaccactacgagccattaattccttaaaagctatttacacctatcacaacagctgtgcccagttagaagctaagaactgcgggtcatcatcattgagcccccttccctcatttcttttctttttttgcttcttccataactgttcccaaaaagctctgattaaaaatttaagacacttagctgtaaccttatctttttttccttattgccagctacattttttgtttccttttttctaggaaccccttcttttttgaactctattctctgccgcaagcatggttgcaccactgtcagcttggccttgggagcacttgggaattttcaagtatatactttacggtcctttagctgcaaaagcatggtattcatggatgtatgaggataatatacttaaggatctatggtgtattcatatactccttatatgcacactgagagggttcattcatcaactatggagctcttacaacaacatgtttttcttaactcgcaaccgttggatcaagcaacaaggtgttgatttcaagcaaatcgacgatgaatgggactgggataatttcataatccttcaagctatgttagcttcaatggcctgtttgatattcccatctttaaatacacttcctttatggaacctaaaggggtttattgcttcattgttactacatgttaccatttcagaacctttgtattattgggcacatagactttttcataaaccctaccttttcatccattatcattcacttcaccattcatcaccagtaccccatccttttacagctggacatgcaacaccattagagcacctagtgttatgtacagtgatcgggattccgataacgggatcgattctgatgggttatggatcgacggcgatgatctatggccatgttttggtttttgattttttcaggtgccttggacactccaatgctgaagttggtccacatgaagttttcaataagttacctttacttagatatttcatctatacccccacgtatcatagtctccaccacacagagatggagaccaatttttgtctgttcatgccgctgtttgatgcattggggaatacacttaacaccaaatcattcgagctacataagagaatcacctcaaattcaagaaaaaacgggagggtgccggattttgtgttcctagcacatgtggtggatataatgtcggcaatgcatacaccatttgcgttaagatcatttgcgtcaacgccattttgcattaagatgtttctgctaccgttttggccacttacatttatgaaaattgcttgtgatgtggggttggtctaaaaactttcttcgtttttttttacaattttcgcggcaatttgcaccaaaccatgggtcgttcttaaattcggttttaagaattttttacaatttgcaacgaagggcatcaacaagcacatagaggaagccatattaagggcggacagattgggggtcaaggttattagcctcgccgctttaaataagaacgaggctctgaacggaggagggacactgtttgttaacaagcatccagagcttaaagtgagagtggttcatggcaataccttgacggctgcggttatccttaatgaattttccaaggatgttaaagaagtgtttctaacaggagccacctcaaagctcggtagagcaaccgctctctacctctgtaggaaaagagttcgtgttcttatgttgacttcatcgaccgaaaggtttcaaaaaatactaaaggaagcccccgtggattgccaaaactatttagtgcaagtgaccaagcaccaagctgctcaaaattgtaagacatggatagtggggaagtggataacaccatgggagcaaagctgggctccatcaggaacccatttccatcaatttgttgtaccgcccattttgcctatcagaagagactgcacctacggtgatctagctgccatgaggttgccacctgatgttgaaggccttggttcttgtgagtatacaatggagcgaggagtggtgcatgcatgccatgcaggaggtgtagttcatcagctagaaggttggagtcaccatgaagttggagcaattgatgtggataggattgatcttgtatgggaagctgctctcaaacatggtttaaagccagtctcgagtgtaaacaattgaaaaaaaaattctttgtcatcaataaataaccatcaaacagtgaaggagaaaatttaaatatatatataaatattttttttaattttgaaaattgaaacatatttggtttgtggttttattctctttattaaaatatactgtgtttggaggaaaacaaatatgatacactttaaattgatagcgtgcaatgcaagtaatataggaaggttattcttcttttcta

SEQ ID NO: 69 - DNA, 1033 bp, Gossypium hirsutum
agggtttagggtttcgagtataaaattcgtttcacagttgatttgaaaagagctcctctgcctttcagttttgggaaaataccagtagatctcaactcaactcaagtgctcatataaacgaaagaaatgagcactgtagttcatagaactccaaaatcggggagacagtcattgttttaccaagatttggcctcaccgatctctgcccggagagggaaattctctagtcctggtcaagcggctgctgtttcagctttatggcaggagaattttggaagttcagatcttccacctcctcctatgtacaccttggaggaccgttcagatttttctcctgaatctcgtatactggattatcctatgtctcccgaaatcaagtcagacccaaaaagcccagttcaaagttctggacatgacttctcaactccagcaaagagcaagtcaggggctagcacttcattcgctatacttaatgggcagcagaatcagcagagcccagcaagtttgagttggtggtcacccgcaaagaatagtagtagtaatgagcaggatgacaagggaaagggttctcctgttgagggtgtcgttcaacctggtgctcttatcacacttccgcctccgagggaagttgctaggcctgagatacaaagaaattctgtacctgcaggcaatctggatgaggaagaatgggttacagtttatggattttctcctgctgacacaaatttagttttgcgagagtttgaaaagtgtggtgtgatattgaagcatgttcctggtccaagggatgctaactggatgcacattctctatctgaaccgatctgatgctcagagagctctcagcaagaatggaatgcaaattaatggagcactaataatcggtgtgaagccagtagatccgatgcaacgtgaggctctaaatgaaagaattaataatcagggtttcatgactttgcctccaccatcaagtggaacaccagagctgagcaatttccgaccatcccgcccaattgtctcgtcctctgcctgat

SEQ ID NO: 70 - DNA, 936 bp, Gossypium hirsutum
ggcattgtctgcttcctgttgttttctccccccaaaaagtctcttttatttgggcattttgctaaacaattagtaatcaagaagctgaagagaggggaggaaaataatggtgggaaagaagagttatttggcaatgaggagtgagcgagaagcaactgatctcatcgtatctgacttccaagatctaatctttgctactaagaagcttgctaaccatgctatcaaattgggttcttggggatttgggactacccttcttgaatggatcgcttccttcgctgcaatttatctattgatattggaccgaacaaactggaaaaccaatattcttacagcactgttaatcccatacatcttcttgagtctgccttccttcctgttcaacatcttgaggggagaagttgggaaatggattgctcttattgcagtcgttttgcgcttgttcttccctagacgtttcccagattggctggaacttcctggagcattgatacttctaatagtggtggcaccgagcttattttcaagcacaataaggaacgactggattggtgtggtgatatgcctaggcatagcttgttatctacttcaggagcacatcagagcatcaggtgggtttcgcaattcattcaccaaagccaatggaatatccaacacaattggcataattattctgttggtttaccctgcttgggctttggtcactgacatcctctagattcagctctgcttctggattgtgtgtgttttagtttcgtcaagttcatgatttgttttttctgcaccattaatttgttgagacgtaccaaaattcgttgttattgttgttccataacactgttttactctgcttgcttttctgaatttgtaaccataccttatttaaaagactttggaacagtaataagttatgttactatatttttaaagatttgt

SEQ ID NO: 71 - DNA, 1265 bp, Gossypium hirsutum
gaactggacagtaggaatggttggaatactagcaggcaccttagaggatgcattgattgtctatgctgacattagtggccaacttccatcacatgagccaacaattttacctcccaagttactttttcccctgctgaactcaacaaatccaatatcagaaatcaagtttgcaagatatggagagtggttcaacgattgcagtgacgaaatcagaatatgctgttccaatgctttgcacttgctttgtgagcattacaaatggaagactgtagaggttactataccagagatagagtcgatgcggctggcccattatctgaccattggctccgaatgcacaacttcactgagttccgctctcgaaaagctggattttgcagaactaggatgggatgcaagagtagcacttagggtatacggtgctttcaacagcaaagagtacataaaagctcagaaaatgaggaaccgccagatgcagattcataagaacatatttgccaaggcagatgtcatagttgctccaacaacaggtgtgactgcatactcaatatttgatgatgctctaaaaaccggtgagctcgattacataaatggagctgcccttgttcgatatcagatagcaggaaactttttaggactacctgctgtgaccgttcctgttggctatgataaagaaggtttgccaattggtcttcaatttatagggaagccatggtcagaacccacattaatgcacatagcatttgcaatgcaggccttgtgcatctcacactataggaagcctaaagtcttctataatctacttcataagaattgagtggggcaggccagaagccaccaggaggaggccggaagggtaatcagtcaccatgattgcatagcttccttttcttcttctcttatcatggtatatggcaatatgtagtattgtttaattatttagtgagttgctactgttgagatgggcgtgtcaaaaatcattagaagctgaaagtgtgtactatgtcattcatacatatctattcttatatgtagatgagatatgtattaaattgcttgttttatggctataattggagttattcttctgttaaaagtagctaatacagaatagtagtgaaggtgtagttgagttactcagggctcatgtgctacttgctgatccatcattaagtaatattatacggtgtaatgactggaaagcattctaattatgtaattgaggccttagacattaattcatttaataaatttgttgatctacg

SEQ ID NO: 72 - DNA, 1330 bp, Gossypium hirsutum
ttgttaaaaagcttaagaaagtgatagatactgaagaaaagagaaagtatggaaggaattcaacacaaaacagtgattgtcaatggcatcaacatgcacatagccgagaaaggggaaggtccattgattctcttccttcatggcttccctgagctctggtactcgtggcgcaaccagatcaacggtttagccgccctcggctaccgtgctttggcgcccgacctccgcggttacggcggaacagatgcaccagattccgtcgccgattacacttgctgccacgtggtgggagacctcatcgcgcttctggacacagtggcgccgccggagaaggaggataaggtgtttgtcgttgggcacgattggggtgccatcattgcttggtacttgtgcttgtttagaccggaccgggttaaagctttgttcaatttgagtgtgccgtttattccttatgatcctcggtttaaaccggtcgagacttggaaagctttctatgggaaggatcattacatcgtccggtttcaggaacctggagtaatagaagcagagtttgcagagattggtgtaggacgagcagttttggagctgttatcgtatcgggtacccgacccactttatttaccaaagggaaatctattcgggcatccactagattctccggttaacttgccgccatggctgtcggagaaagatgccgattactatgccacccagttccaaataaccggcatcaccggtgccctcaattattaccgcaattttgatcgaaactgggaactatctgcaccatggtggaaaagccagatcaaggtacctgtaaagtttgcaatgggggaccttgatcttgtgtatacaatgcctggtatgaaggattatattcacaacggtgggttcaaaagggatgtgcccttccttgaagaagctcttgtcatcaatggagtttctcattggatccaccaagaaatacctgatcaaatcaatcaattattgttcgacttcttctccaagttccattaaattttaataataataacaaaatccaaatttagtaaaaatagaaaaaaaaaacatgttcttcgtttgttgtttttaatttttaagtccaaaggttgattcgaaatttgagaggattaaaaagaatattagatccaaaaaataggtttggataaaaatattagttttgtttaacatataaatcaggtttaggcttgatctttcaatgtttgagctcgacctgattattaaggttataatatattgttacttttatatatgatgtaatatagttatctacaaatatagacgaacttgaataagattttaagtttat

SEQ ID NO: 73 - DNA, 2050 bp, Gossypium hirsutum
  misc_feature (7)..(7): n is a, c, g, or t
aggcagncattaaagcctgtgagtcaataatgcttttagaactttctgagatgcaaaatcagctcaaggcccttcaacgcaaacatattaagttactggacaccttgcggcaattagagactgagaaattagagctggaaactactgtagttgatgaaacaaaggaacgcaagtcatattgtggacgatttagtgatttctactctgtcatgtcagaaggtagtgcaactgattctgatgcggataatgaaagtcaagatggtgcagatgttgaaacagatgaagatgatggaatatattttgatacaaatgactttttgtcttcagaagctttaagaagtgcttcctatcggtgtagagaaaagtggaagtggctgtgtgtttgacaaagatgcttcattttctgattgtgtgtgggggcctgaaaaggaaatcaggatcattcaatatccttatgtcaaaagaagggataacctgccagaaccaaaggagaaagagaagccagttggcttgtggtctattatcaaggataatatcggaaaggatttatctggtgtctgtcttcctgtgtactttaatgaaccactctcttcactgcagaaatgctttgaggatttggagtattcatacttggttgatcgagccttggaatggggaaagcaggaaaatgacttgatgagaattctaaatgttgcggcatttgctgtatctggttatgcatcgacagaaggtcggcagtgcaaacctttcaatccacttcttggagagacctatgaggctgactatccagataaaggacttcgtttcttctctgaaaaggtgagtcaccacccaatgattgtcgcctgtcactgtgaaggtaaaagctggaaattctgggcagattccaatcttcaaaggaaaattttggggacgatctattcaactccatcctgttggtattctaactttgcattttgaggatggagagacttttcagtggagcaaagttaccacgtccatatacaacattatccttggtaaaatctattgtgatcactatggtaccatgcgcataaaaaggcagtgggcaattactcttgcaagctcaagttcaaggagcagtctatcatagaccgaaatccccatcaggttcatggatttgtgcaagacaataggacaggggaaaaggttgccatgttggtggggaaatgggatgaaggctatgtattatgtgctgggagatccaactatgaagccaaaagggtatgacccaatgacggaagctgtgttgctgtgggaaagagacaaatctgctactaagacaagatacaatcttacatcttttgcaatatccttaaatgaattaactcctgatttattggaaaaattgcctccaacggactcaagactgaggccagaccagagacacttggagaacggagaatatgaaatggcaaatgcggagaagctgcggttggaacagttacagagacaggcaaggaaattacaagaaagaggatggcagccaagatggtttaacaaggatgaagatggttgttatcgatacatcggaggatactgggaagcaagagagaaaaggaaatgggatggaatccctgatatattcggccagtgtagcggtagtagtcataattcaccttcatgtttgatcgaagagtgagtaagctatattttgtttctgcttgctcggcttatattttggttattatttatatctttgtcccgtctcatttcttgtctacgaagatgatgattatgacaacctcatgaatctagatagatgtaagcctaatgagctttacttggggtgcaattgctttgtcaaattcagctctattagatgcccttcctctgggcagtagtaatccatgaaaacatcaacagaattgcatattttgcccttttatcttataatctataatatatgtatatgtgaagaatttcttatcggtgcaaatgaccaatgataggacttacaatttacaggtccatggcctgcaaatcatgctgcaacagctaaaacagattgaacataacaaaaatcatg

SEQ ID NO: 74 - DNA, 1301 bp, Gossypium hirsutum
  misc_feature (1115)..(1115): n is a, c, g, or t
cgcggccgcgtcgaccgagattgagaccaaagtgtcttaacttcaacatctcatcacttctcaattctaaccacccaaactcatcttctctcctccaccatgaaacaacctccgccattgttcttcctcctctttcttctctccgccaccatcgcctccgccgctacaacgcccacggtctcccctactccttcccccacatcctccccgaccccacccaccaccaaagcaccatcatcttcctcatctcctctagaccctgaacaaatgaaaacacttcggtccctccacatccctaccacaagagacccttgcattcaaccttcccctcgcaacgccaccatctgcgacaactctaagcccttgcgccacctcatttccctccacctctccaactgttcatccgaccttttcctctcctccgcagctctcaagtccctctcttccctccgttctctatccttcaccgactgccaggtatcccctgtccgcttcccttcccagctctctctttccctcacttccttctcctgcattcgatccctccggcgtctctctggggtctggctctcgcgtttcgttaacctcactgatctcagagtttcctacactccggttaaggccagcggtctttatgtaatccttggccacatgcatcagctgaagacactcaccatttctcatgctaatctttctggttctcttccaaggcacttgaatccggatctgacccatgttgatgtatctgataacaagctcaaaggaaaggtaccaacttctcttacgcttcttgaagatcttaaattcttgaatctttcttcaaacgggctagatggggagattcccactgagcttggtaacwtgatatccttaaagaatctgtcattggcttccaattcgttctctgggtcgatcccaagttccttttcagctattccaggcttggttcatgtcgatctgagcaacaaccagctaaacggaagtgttccaaagtttttgtcagagctgaaagggttgaaagtgttgaatctggagaacaatcagctcaatggggttttacctttcaatgctagcttcataaagcggttggctgttttcaaggttggtgggaatancaatttgtgttacaatcattctgttttgtcatcaaaactgaagcttggggttgctcgttgcgataagaatggatttccgattgtagcgccgcctccgaaggagtcctctgcagatagtgagagtgattatggtgatgatgatgcagttgattcaggtaataagaaagagaagcatcacgggccatt

SEQ ID NO: 75 - DNA, 1677 bp, Gossypium hirsutum
aaactagtttccatcaaatcttttagctttttcaagaaaaaaaattaaaacccagtttttttttcttttttctgaatcacccatcaccatgaatggtgaaaaaaacagttcaaacaatagggtacttaaattaaagtacgttaaacttggttaccattatctcataactcaccttttaaagctttgtttagtccctttaatggctgttattatcgtccaagcatcgaggttaagccttaatgacatccaccaaacatggcttcaccttgaacataaccttgtctatgtcgtcgtgttgtcggctttcgttttggtcgggtcgaccgtttactttatgacccgaaaaagatccgtttatttggtggattatgcctgttatctccctccttcgaagctaaaagtggaacacgaccggttcatgaaacattgtaagctaatgggttgttttgatgagacctctttggtgtttttagacaagattttgggaagatcagggcttggagaagaaacatgtgcaccagaagcaatgcattgtcttccaccaaaaccatcaatggaggctgcaagacaagagacagaacaggtgatgtttggtgctttagataccctttttgctaacactaatgttaagccaaaagatgttgggattcttgtcgttaattgtagtttatttaatccaacaccttcattatcttcaatgattatcaacaagtataagatgaggggtaatattaaaagctttaatcttggtggtatgggatgtagtgctagtgttatatctgttgatttagctaaagatatgttacaagttcatcggaacaattatgccattgttgttagtactgaaaatattacacaaaattggtattttggtaacaaaaaagcaatgttgttaccaaattgcttgtttcgaatcggtggtgctgcggttttattatcgaataaatcattggaccgactaagaagcaagtataaacttattcatgtggtacgtacacattgcggtgctaataataaggcgtttaactgtgtccgacaagaacaagatgatattgggaaaacaggtgtttcattgtctaaagatttgatgacgattgctggtaatgcacttaagtccaacattactacgttaggtccccttgttcttcctataagtgaacaaatcttgttctttgtcacattagttgccaacaagttgatcaatgctaaaatcaagccttatatcccggatttcaagctcgcatttgaacatttttgtatacacgccggtgggagagccgtgatcgatgagctcgagaagaatttgcaccttcttccggtacatgttgaagcttctcgtatgacgcttcaccggttcggtaacacctcatcgagttcgatctggtacgagctagcctatatggaagcgaagggtcgaatgcagaagggggatcgggtttggcagatcgctttcgggagcggtttcaaatgtaacagtgcagtttggttggcactcaagaatgttaagccatcatgtaatagtccctgggaaggttgcattcataggtatccagtgcagcttagcctgtaatgagattaatcaaagcgattttcaatgtttattattttgagtgcttaaatttttaagttgaaatatgtaataccttattttcataaatttgaaatttaattatttta

SEQ ID NO: 76 - DNA, 1377 bp, Gossypium hirsutum
cgctttttaagaaactgacctaaaacctcaccgtctattgagagtctgcacgctttgacccttccgctttcaaaaaattttcaacacacaaaattggttttaacaattaaacacaatctaaagcggtgttggtagcagccgctgcacggtttcgtggctgatcctctcttctctcaaatctttgttgctgtggttgattgcccttctatcaagatggctggacctgcaccattcgtagatctggggaaaaaagccaaagacctcctgacaaaagattacaactttgaccagaagtttactctttcaatgctgagcaccacgggaatgggacttacagccacaggactcaagaaggaccaaaatttttttggtgacataaatactgtgtataagagtggaaatactactgtggatatgaaagttgatacctattctaatgtgtctacaaaagtgactgtcaatgatgtctggccatgttccaaagctgctctaagtttcaggatacctgatcacaagtctggcaagttggatgtccaatatcttcatcctcatgctgccattgattctagcattggcctgaatccaactcccctattggagctttcagcaacaattggcagcaaggagcttgctttgggtggtgaaattggatttgatacagcttctgcttcttttaccgagtacactgctgggatcaacttgaacaagccagatttctctgttgctcttttgctgactgataaaggtcaggcattgaaggcatcttatatccattctgtcaaccccttcacttgtgttgccgctgaaatggctcatagattttccacctacgaaaacactttcaccattggaagttttcatgctgtggatccttttaccgtggtaaaaacacggttttttgacaatggaaaggttgcaatgctgtgccaacgtgaatggaggcccaagtcacttgtaacatttttggcagagtatgattcaaaggccataaatgcatcccctaagatggggcttgcccttgctttcaagccttgacgggaaggtctcattttggattccgtatttttaaattttgatttgaccttttccccgaacccttgggagagttgttattcacccagattattttgtatcgaaagattataaaagaaaattgttcagatactgagttgatgaatgttttccccagaacaatggtgggagaattgaacccaaatttgccaaaattttatgaggataacagcacagcagtttttgttgctgaatgcttttaatgttcatgtcgtatgatagtagggggtgtttcccctaatgttgtattgaacatcccagatttgtggtcaacaatcccttattgaagtaactgccttttttttt

SEQ ID NO: 77 - DNA, 694 bp, Gossypium hirsutum
  misc_feature (553)..(553): n is a, c, g, or t
cgggaggggaacatcaaatacctactgtgtggcaaaatatggtcacaaatgggtccgcactcgcacccttgttgacaatttatctgcgaaatacgatgagcagtacacttgggaagtatttgatccagcaaccgttctcaccgttggtgtattcgacaacagccagcttggagaaaagggttcaaatggaaacaaggacctgaagattgggaaggttaggattcgtatttccacattggaagcaggtcgtgtctacacacattcttatcctttgttggttcttcatcctactggagttaagaagatgggggaattgcatttggcaataaggtttacgtgtatatcttttgtaaacatgctttaccaatattctcgaccactactacctaaaatgcactatgtaagaaccttcagtgtgatgcaacttgacatgctacggcagcaagctgtcaatatagtggcagcacgtgtaggtcgagcagaacctcctcttcggaaagaaataatcgaatatatgtctgatgtggactcacactttggagcatgcgtaaanaccaagcaaatgtcttcaggctaatgacagttttctctggattgtttggctatgggaaatggtttggagatatctgcatgtgggaaaatccaatcacacagttctagttcatgtgctctttctaatgcttggtggctcccc

SEQ ID NO: 78 - DNA, 2530 bp, Gossypium hirsutum
  misc_feature (53)..(53): n is a, c, g, or t
gaacttaggtcccccacctgggttagggtagccagtctctagccttagcagancctgcctagctacctagctcttaactcgcccaaacacagcagtcaatcagaaagcaattgaaccccacaaactcatagtcctacatagttccacactctgcaaagaactgagaagagaaaaaaaaaagaggttgtttaactttttatttttctcgagaaaatataagagttgagttggagagaagaagaagaagaagagaaaaagatggggttgatgatggatcaagtttgaaggcttggggggttagtataaaaataaaaatcacccctttcaaaaacctggaaaccccaccaaatggaacttacagatttgcaaagcaataagcaaaccaaaaacaacagcagcagcagcaacaataacaacaacaattctgcagaaccccaccatcagtctctccagcagcaccatctgcaacaccaaaaacagtcggcttctccccagcttgtggtcccttttgatggcaccagatcttcaggtccttcttcgggcaacccttttaatatgggctccatttctcacctccatccccaccacccttttcatcatcttcttcttcatcctgcttcttccacaactaccaccaccacaacaccgcctctcccgtcttcatcttcttcttcttcctcctcttcttcagcttctacgactacaacgaacccacctcaactcgttgacgcctctctcgctattgctaccagatctacttctctcaacatcgattccaagaatcaaaccgacttgccaatttcatctacgacgacaccagcatcgacgacgacgacgacgactacagctaacccgccagtgaaacgctccaccaaggaccgacacaccaaagtcgatggtcgaggccgccgtatcagaatgccagctacttgtgcggctagggttttccaattgactagagaattaggtcataaatctgatggggaaaccatcgaatggcttttacaacaagctgaaccagcaataatagcagccactggaactggtactataccagccaatttttcgactcttaatatttctttaagaagtagtggatccacgctttctgctccgccttcaaaatctgctccacactcgttccatggtgctttagctttggcttcccatcatcatcaccatcacccttatgaagaagggtttgctcatagcgctttgttggggtttcagcagcagcatcttttaacggcagatcaaatagctgaagctttacccggaggtggaggtggagatggtgggaatttaagtgagaattatatgaggaaacgttttagggaggatttgtttaaggatgatgatcagcaacaaggtgaaagtggtagtggtggcggcgatggatcccctattaaggctttcaaaagtggtttaactcaattgtctaaaccacaacaagatgctggatcttcggctctacctcgaccctcaaatatcctgcccggcacagccatgtgggcagtggcaccagcaccaagcagtggggcgggaagtacgttttggatgctgccaatgagtgctggtgcttgtggcccatcagtggcgccttcagctgcaactggggctggtccatctgatcaccctcagatgtggccttttgggacagcaaatcaagctagtggaaatacactgcaagcgcctttacattttctaccaagattcaatcttccaggtaatgttgaattccaaggtggtagagctagtcctttgcaattgggttcaatgttaatgcagcagcaacaccaacaacaacagcctcatcatcaccttggtttaggaatgtctgattctaatttaggcatgttggcggctcttaatgcgtattctagaggtggctcaaacgttaactcagaccaaaacaatccactggaacatcatcaccaacaacaccagcctcaaggtacagacagtggagatgaccaagaccctaatacttcacaatgatgctcagagaattaaatatacagaacttggttagtaggctttttaattccctattgagtgcctgccttccatttatttctttttttcccttgagaaattgaatgcgttccagcatataaacagcaactggaaactagagagtgttgggtttgttttgtgcagatatggaacatcaagtttgtgatcatcagctgattacttgaaacttttcagtggattttcgtatggatacagaaacaaaaaaagcaaccatatatatatattaaaggttccaagtaggtgccattgtttgtccattgggttttgttttatgaatgccattagctatagatttgatgtgaagaagtttgagtttgtaatttatgttgttgtggtccaaaggggacacgatagggaacagtaatgagagaaaagagagttgttttgtataggaggatattcgtttgtgttgatttttattacagttttttttgctttgttttgtagacaagcaaatgaattatttttgttataaaaaaattattagtttgca

SEQ ID NO: 79 - DNA, 1293 bp, Gossypium hirsutum
aaaagttcgcgttcccaacttatttgtttctctcttgaaaatcaggatggctacctccctttgtactcatgttcccgccctctttcttcttcttcttcttgtttcagctccatgcaatgcaggtattctcaggacatgcaagttcgatgccatatatcagctgggggattccatatccgacaccggaaatctaatccgggagcaccctttctctccttttgctaggcttccttacggtggaaccttcttcaagcatgcaaccggtagatgctccaatggcttactcatcatcgattttctagctttatctgctggaatccccttcctccagccctatttaaacagtaatgcactattcactcgtggccgtggggtgaatttcgcggttgctggctccactgcgttacctgtggagactctagctgataagggagttgttgcccctgttaccaattcttctcttagcaggcagcttgactggatgttcacccattttaatggcatatgccacgatgaggatgattgtttggagaagcttaaaacggctcttttcatcgttggggagattggagggaatgattataactacgccttgtttcaaggcaaatcctttgaccaagtcagatccatgatgcccttggttattcaagccataaaggatgctgtaacaagagttgttggttatggtgccactcgagtgattgttcccggaaactttccaataggctgcttcccggtccacctcacggtattccggtccaatgattccgatgcctacgacggtttcaattgcctcaaggacttgaacaacttgtcaagccatcataacggccttctcaaacaagccattaaagaattgagaaaagaactccctcatgccaccatattgtatggcgactactacaatggatacatgaggcttttgaacaaagctaaatttcttggtttggatccaaattcaacacaaaaagcttgttgtgggattggaggagattacaacatggagctgaacaaaatgtgtggagcagcagaagtgggagtgtgtaaaaatccagatgaatatataagctgggatggagttcatttgacgcaaaaagcttatcagttgatatcaggatggctcattcatggcgtttattggaagcttcgatgcggggtttgagcatgtcatgcctttgttttagtatttctgtataggcattgcatattttttggatgcggggtttgagcatgtcatgtcctttgttttattaacttaagaatcatattttccataaattactaattaacata

SEQ ID NO: 80 - DNA, 968 bp, Gossypium hirsutum
  misc_feature (950)..(950): n is a, c, g, or t
acatgcttacttctcttttagtattattgtacataaataagaggaaaactgaagcgacatataccacaagtgcatcaattggtatgcgaaactggaatgcagaaagaatcttctcctacaaagaaataaaagcagctacaaataactttaagtgaagttatatgccgcggtagctttggatccgtctacctcggaaagctatcagatggcaaaccggtagctgtaaaagtgcgatttgataaaactcaattgggagctgattcttttattaacgaggttcatctcttatcacaaattcaccatcaaaatcttgtgagcttggaaggattttgtcatgaattgaagcatcagatacttgtctatgagtatctaccaggtggatcactggcagatcacctgtatggtccgaatagtcaaaaagtttctttaagctggattcggagactgaaaatagctgttgatgctgcaaaagggctggactatttgcataatgggagcgatccaagaatcatacaccgtgatgtcragtgcagtamcmtccttttggattgtgagatgaaygcgaaggtctgcgatttcggcctctctaagcaagtaactctggcagatgaactcatgtgacactgttgtcakggcactgggctatctaratctgagtatatccacccaaastgactgaamaktgtgttatagttttggggttgttcttttaaagctcatatgcggaagagaaccgctgactcattccggaactccagattccttcaatttagtgctatgggcaaagccgtacttgcaggcaggtgcattggagatagtggatgacaacttaaagggaaccttcgatgttgaaagcatgagaaaaacagccttagtcaccgtacggtgtgtggaaagagatgcttcacggagacccactattgcacaagtgttgggtgagctgaaagaancctacagtcttcagcttt

SEQ ID NO: 81 - DNA, 633 bp, Gossypium hirsutum
ggggcttcagcattggttaaatcagtacatcctaaatggacttcttccatgatcagatcggcactaatgacaaccgcaactgtgtatgataacatgaggaaaccagtgacgaacggttcggcttcttttgccaccccgcacgagatgggagttggagaaataattccagttaaagcccttaatccgggattagtcttcgaaacaacaaccgaggattacctaagattcctttgttataacggatccccagagaaaactatacgttccatgtcgaaaacgaagttcaaatgtccaacgaaatcctctgatgatctcatttccaacatcaattatccatcaatctccataagtaaactagaaaaaagcatagggttcttaactattaaaagaagtgttacaaatgttggacacccaaatgtgacatatacttccactgtgcaagctcccatgggaatgaaagtgaaggttatacccaaaaagatcacatttttagagaatgtaaagaaggtttctttcaaagtgttatttgatggcagtgaggcttcaagtggatataactttgggtctataacatggtctgctgctcaatattctgttcgtacggtgtttgcagtgaatgttgagtgataaaac

SEQ ID NO: 82 - DNA, 867 bp, Gossypium hirsutum
gaaatggagagtgagctcaataacttgattaagttatgggtcttaacaacattttcattgtcttattcttatcacatttcagcaaagatatcaaagggcttcccaaggcttgtttcaatcttccctgtcatctttctattatcaattctcccctttaacattcatggtttccatcttggagcagcccatgtgtttgtcctttcatggatggccaatttcaagcttcttttatttgcctttgatcgaggtcccctttcaccccctcctgaaaactttattcttttcatcctcgctgcttgttcacccttcaaaatcaaagaaaactcagtcaaggttctaaagggtgaaaccccatttcagggaaatcaaccaagagttcccagtttgatcctagaggctgtaaataaagcttcgttgctgacattacttttttattcctataactttaagcaatattttcataaacatgtcctgttaatcctttacttcttccatacttttctttcaattcagtttttgttggctgtggctgcaatcccagctcagatctgtcttcctggtgtggaactcgaaccacagttcaatgcaccacttcgagccacttcattgcaagacttttggggacgtagatggaaccttagggtctcagaggcacttcgtctgaccatatacagccctataaaaaccatttcttcccgtgtaattggatccagatgggcttcattgcctgctgtttttgcaacatttgtcagttcgggttttatgcatgaactgatatattatcatataatccgcaaaaagcctacgtgggaaattacttggttcttcgttttacaaggagttctggttgatatagagatttttttg

SEQ ID NO: 83 - DNA, 1131 bp, Gossypium hirsutum
agaacaataaaatgtgcacctcaagcggctcgaccgagctctattgtgaaaacgttggttgggaaaagaagacaaattttgagaagtctaatccctgggggagaatttatgaatggcgtctcttygattctgatacactttcttggatctgttgaactgctttccctctctgcaacttcgtttccgcttcttctctctagattaaattttttgctattttctctttctatacaagaacaagttttagcaaggatgcgttctcctttttcactgaagcaggaatttctcaagaaatggatactgggtctccaaagatgtcgttcctcaaagaagaatatgagcatcttcgagagaaaaaaggttattaagttgtcagcagatgtagccatggcttctgcaagaaagggcacaacttgttggagtcgagctctcattgccgatgccgttaaagaaggcaatgctgacaaacatctagctgagaaaatattgggtccggcgtcagagaggcaaccgacgaagaaggttccagtaggagcaatggcatacaacaagaggatcagaagcaagaagatcctgaaaaggagtagcgtaatccgaagaacaataaaatgtgcacctcaagcggctcgaccgagctctattgtgaaaacgttggttgggaaaagaagacaaattttgagaagtctaatccctgggggagaatttatgaatggcgtctctttgattgaggaaaccctagattatatcatatcactccgagctcaggttgatgtaattcgaagtcttgccagtgcttcaaagttagtgaaccttaattaagagcatcaatggtaaattgctcttcagttaattatttaatatatctttataatatctttatttttttctcttgggcccaacgcttagctagctaaatgaaaggaaatgggaagctggaacagttgaggcatgcctgtacagatgaactatatatatgtaagccaatcaaggctttcatttcaatcttctacaagaccttgttgacttgcattaagtttttaatgacaagcataagtttcttatatatttgtagtttctatgcctagtttaaaaccaagtatattatgcttcatcttctaatttatattgtgc

SEQ ID NO: 84 - DNA, 1101 bp, Gossypium hirsutum
caaaagccaaggtcaaacgaaggcaaacataaggttttccatggaaggggaagctggttcatacgaggacgttaagccaaacgtcgtcgctaaacaaagtaatggcgatgttgtcggggataatggtgttggaaatctgggatccgttgaagcccctgattttctttccaagaaaaatttccagaactgttccgtggcaactcctgcatctggactgaattccactagccctgctccatctcaactaaccatcttctatgatggacacgtttgtgtgtttgatgcaattcctgtggaaaaggtgcgggagattatgcttattgctgcaactggtgctgctaactctgttgacatgaagaaagttgcaactgattgtgccaccacctcacctgttcttacgaggtctccttcgcttcaaagtactgctactgcaactgctctggcttcaccacaggcacaggtgtatcctactaacaggacccctttctgcaaactgaaagaactaccaattgcaaggagacactcccttcagcgattttttgagaagcggcgggacaggctggtgaacaggaatccatatcctaatccatcaacaccaaaatcatttgatgacaccaaagctaacctcagtgctgcaacttcatcagaatcgggttgctttggtaaatcacctgttgctcaagaagaattccatccaaaagctccagctcatgttgcataagttaagcatatacgaatccctatatatatttgataaaaactaaactagctgtgttattattgtgaaatgcaaactgaactaggataatgactttgatctgtcggtggagttgatgttgtttgcaagtgtacaacttaaagtaggtctcatggtaggtttgctattgtttgccatgagagtgttgtctaaatgtagaatcaattctcttgttctcctattgcctctagggggccgttgtgatgtcttttaaacctaggcaccatgtctatattctttctgccaattaacaaactaagctatctaggatctgctatgtatgtatcttcaccttggttgtttctatctgttattttcgtaagtgaagactgatgatttgtgcg

SEQ ID NO: 85 - DNA, 1276 bp, Gossypium hirsutum
gtggggaattcatggaatggctcggatctttacccagatccttgtggatggacacctatacagtgagtttactgtgatctgctcgatgggtattggcatgtcactgttttaaatattggtctagtttttgacaactctcttcaatgtagcccaaatgcaaagttcacacatcacctgtttgagcttattcacttaagatcactctcattcttccattgtttttcctcgcctagagataaccccattagaatcccttcctcaaattgggaaagactctcaaacagcctagaatccttggagtttagatccaatggtggtctcattggtacaattccagtctccattagctaccttaaaaagctccgatcattagtgttactagaaaatggattaataggagacttgcctatagaattagggaacttggtgaatttaaagcaacttgtattggctggaaacaagtttactggtcaaatcccaccaagtttaggagggttaactgagttgttaataatggatttaagtagaaacagtctaacagggaccttgatgttgactttcgggtgtaatctcacttcattgctgaagttggacttaagcaacaacaagttggaaggaaagatacctgaagggattggaaggttaaagaatgcaacacttttggaccttggcagaaacaagttctcaggtgggttgatacagtcatttcaacgactggtttctttaaaagagatggtgatatcaaataatccgcttgggaggtgatctcatgggtgttgaatggggaaagttgccaaaatttggagatattggatctttcaagtatgggggttaacaggtttagtaccacaatccatggcagggatgaaaaagttgagatatttggggctaaatgacaacagtctgacaggaaatctttcaccaaagcttgcaagtcttccttgtctgaatgctctttatgttaatgataataatctgacagggaagcttgagtttgcagaagggttttataagaaaatggggagaaagttcagagcttggaataattcaaatctttgctatcagcctgaaatgatcccatcatcatcatcatcaagccatggtcttaatggggttaaactttgttaacaagaaacacaaaggagaaaaaacagttctagtaaaacggattttagaggctttattttctcagttcaaattttaatggatatatttgttaaaatttcaccatgtggatttccccccttaaattattaaattatctctttgccagtct

SEQ ID NO: 86 - DNA, 600 bp, Gossypium hirsutum
cttaaaacctctgaaaamccctcacctggttgccggctycgtttactwaaaattcaaggtatcttacgtttgcttacygtcyragacaatggrtgagttgccaacacaaagcacatctgccttrgcctyrcctckcttacagctaaaccggggatcaacaacggcaacatctggtccagaatcaaagccaaagaagaaaatttgctgtgcttgccccgagacaaagaagctgagagatgaatgcattgtggagcatggtgaagaagcttgtgcaaaatggatagaggctcatcgtatatgccttcgtgcagagggcttcaatgtttgagattggtatttgaagttcatagaatgaaaacaatttgaggtacaaactagttattagaggattaaacagatatgatttgacaaaaaagaatccagaaataaaaagaaagctttatcgtaaactgttcatttttgtdtttttatttttcttttttatgaggttatttacctctattgaatgaattgaaacatctggaatgcttatatgaatcmtgataggatagagcgaaactctgtatgccytggtccttgagtaaacatttccccttctgt

SEQ ID NO: 87 - DNA, 1527 bp, Gossypium hirsutum
gtcatccttttttttcctccatttatttttttcgttttttgtacccttttttttttcacataaaatccccctttctgagtctcttctctcaaaagtgtaaaaagaaaaatataaaaacaacagagtctttgaaacgatgtcgtgttcgtctccgatgaggaaaacctcgtgcctttcacgtaggttctcgagatcattgagactgtctgccagaacggcggcgttaacaacagtctcgaccagggagaatcacctggagtcttcttctacatcatcaccgtcttcgccgccgccgttggcggaggctggaggggattcatggtcgacgttgctgccggaattgttagttgagatcatggagcgtgtggaagcgagtgaagaaatgtggcctgacaggaaaaacgtggtttcgagcgcttgcgtatgtaagaagtggagagaagttacgagggagatcgttaaggcttcttctcaaaatagcggcaaaatcacttttccttcttgtcttaagcagcctggtccacgggagtttcctaaccagtgtattataaagcgaaacaaaaaaaactcaacattcttcctttatcttgctctttcaccatcattcaccgagaaggggaagtttctattggcagcacgaagatatcgacatggtgctcatattgagtatattatatcccttgatccaaatgaactatctcaaggcagtaatgcctatgtcgggaagttaagttcggattttctaggtaccaactttaaaatctatgatagtcagccaccgcacagtggtgctaagccctcgagcagcagagcaagtcgcagatttgcaagtaagcaaatctgcccccaagttccagctggcaattttgaggttggacaagtgtcttacaagttcaatctgttgaaatcgagaggtcctaggaggatggtttgttcaatacagtgccctttgccggaagatatggctgatgagaagtatttagatgacatcaagatgaaaatgcccgagcatgcctcatccggtcatacaattttgaggaacaaagctccaagatggcacgaacatttacagtgctggtgcttaaatttccacggtcgggtaactgtagcatccgtgaaaaactttcagctggctgcaactgttgaagagagccaactgggagggaaagaagaggaggaaaccgttctccagtttggtaaagtaggggatgatacattcaccatggattataggcagcccttatcggcttttctcgcttttgccatctgccttacaagctttggtacaaaattggcttgtgaatgattttactatgtttatgtactatcatatacatatatatagtaacaagttgtgctacatgttttaatataatatttttttttcttaaatgtcacttgaaaaacgtttggagagccttggcttggtgagacaaaatcaaaatcatgtacatgttttctctttgtatctaataacatttgctgaaattattggtttaaaaatatcttgggacttttagttgcatc

SEQ ID NO: 88 - DNA, 1343 bp, Gossypium hirsutum
  misc_feature (1281)..(1281): n is a, c, g, or t
atatgtatataccccatatggtccggagaccttttgcataaattggtggttaaaaatttcaagaatgtggcttcttccttggaaggctgtgttaatggatatctgcaatgtgttgaatatgagaggatcccttccaaaattctcacttaccaagcatctgatgatcctttgtatagtgcttacagatcagttgtgcagtcttcaagccaagaggatactctgctagattttgccttatgggagcctccacacggtccttatagatcattcaactacccatggagaaactatgtcaaagtaagcggtgcattgagacattgtgcattcatggtcatggcaatgcatggatgtatactttcagaaattcaggcaccagcagagaagagacacgtgtttgctcttgagctgcagagggctggtaatgcaggagctaaagtgctacgtgagctgggacagaaagttgaaaagatggaaaagttaatccccggagacatactgagggaagtacacgaggcaggagaggatttgcaaatgaagatagacgaaaagtcataccttctagtcaattcagaaagctgggcaactgcaccgcctcacagggaattggaagaatctgggagcatggctgatgttaaagacaatgagcataaagtgataaaatccctgagcgatatgtgggaagttcagcacacgattgatcctcgtgcgccggacttaattacctcggagagcatgctccagaaaccatcatggccccgtctctcgtttactgcagaagcattgctacagcaacaggaatctaaaatatatgaaagtgctagtgctttatccttagcaacgttcgcatcactattgattgagtttgttgcaaggctccaaaatctcgtggatgcatttcaagagcttagtgagaaagcaaatttcaaggttcctgtggaccaatcacctcaaaaggaggctccaggattttggagaagattaagaaattgctttcagtcaaagaactaaattctatgagtgtgttttggaacatatattttgggcttttttggaattaagtaggttcaaatacagttgttaagggagacaaaagcttttagattgatttctacactgttgtaactttccagatgcattaaatttgcattgatgggaaagaaccttcatatagaaaggcaaagggtgagcttggaaactgaaattatcttgcacaaagcttcttttcttcaagttatttattaaatatgttaatggtaaagcacagtaattgaagtttctganggcgggccaatttccctaaggggaaccccctatttcaaaagcgcccccccccgcggggaacc

SEQ ID NO: 89 - DNA, 1577 bp, Gossypium hirsutum
  misc_feature (1565)..(1565): n is a, c, g, or t
cccgracccacccaaaaccawaaccctcatttcccacccaaaaacccttccaaagaataggcgctctccgtttcccatttgtctcttaaaattgcaatccatttcaaacccctcttaaaacccttgaaatcatggcctttgcagagtcccaaaaccccttacgagttcatagaatccagcagtccaggtacatcgacgccgtccgctggctttcaccggtttctccctccgacagattcgcagccatcgcctatttcgacgctgataccaactctccctccatcgaaatcgcatacgttgacccaaacccacaaagctcgtctccaaccttaacccctcaatcttcatggacctcaccttctcgcatttcgtmcctcagaaccgcccactctacccctcagcccctgctcgctgccgccactttctctggttcacttcacattttggcctctgatttaatcaatggaggggtgatggaatccgaggctacagtttcggagttggggtttcattccggacctgtgtcggccgtggatttaagggaaggtgggactgagtgcgtcagtgttggagaagatggtagggttaatttagtgagttttgttggggattcttcgaagctgaattacaggagaattttcgactcgaatgggctagtgggttatacggcggttaagtgggcatctcctagtgagtttgcgactggtgggtatggatttggaatacaatggtgggatcagagaacacccggtggaccggttttgcagtttaaggggaactggtgccagggtaaaacatctggaattgtacactcaattgatattcatccatcgcggaaacacacttgtctggcagggggctcttcaggcactgtatttgcttgggatcgtagagctgcacaacagcctattgttctttctggtgctgggacaggtgaggctcccaattctttgttatctgaaagcgaggtttgggaagttcaatatgatcgctacacwaggcgttcgaacattrgcaacatctcttccacacggattctacctgttatgatctgctctgaagatggaatcctcgcagtaatcgaacaaggtgaagaacccttggagctgttagccgaaccctgtgcaattaacagctttgacattgatcggcagaacccttcgaatgttatatgcagcttggaatgggaatcgttagccatcttgacaaggtcttgatatgaagaaacaaacctgtcggtaagaaacacaacttaaggagtgatcagtgaagttgaggatattgaatatcattaggccattctgcaggtcttagtagaaatagaacgactaattatttgggttctcaaagtggatatgccctgggaaatatattatatcaacccataaaatggaatggattgtttacatttggcttaatagatgtgcaaggaagaaagaaagttacccatttgatgggtaaacttaaaatcacatgtcttcttcattagccaytacgtttgaagcttgcttgaaaaaaattgattwaattgaatctaattcgaatttgtttgattggaacatgangttttgtttggc

SEQ ID NO: 90 - DNA, 1238 bp, Gossypium hirsutum
taaacacaaccatgcagtggtcaccttttgaaaattttagtgcttttggggattcttcagcaatgtctactaaatggcaagatggacatgaggttcaagccccccctgttgcaactggcactcagtcatggaatgcttttaatgattcggttgaatcacttcctcttgaacctcaagtagtagcatacgaacatatggccaccactgatgaacatttgggcttagcagtttcagagaaccatgataattatggcatccaaactgctgactcccatattggttttcctgctgctactctaccatcagagaatggcatagcaccattatatgctccatcaatgaatccacttccgggagagaaagagacacaagctgctgatcttaaaccaaccaacccatttgatcttccttttgattctgaattggaacaaagtgatatgttcttcgatatgagttcattacaaagcacacttcctaatgctcagttgccttccacctttcttggtgtatcgcaaccatggcttcctcagaatcccacaccaccacaaggtggattagtctacatgtcaggccaaacaccaagttcgcaattaccgaatgtcccagctcaaggtcctgttgcttccatcggaggaaatcctttcgcgtagaaactacttagcaacaatagctttttttagtacattttcagtctgggtagtttcctggttgccaaaatataatcaatctttcagtgcgtacattagaactaattcccttggcgaaaaataataccattgtggaggctgaaaattccgtttagtgttttgtgtcttagaggcctcatgcttgtatgtgattcagttgttagaagcacccaggaaagggttgtagggggagataggctttggtttaatggtgcttagggtggcaaagatagtataatggtattgtaattgttagcaactttctatttttgactgtttcactagcaaaattggagaggtttttagcaatcttgaaccggtttttgcttgaatccttctacaggttatgcatacttgcttttacttttattgagtacttgaatttttgtgttctttttttgctttgatattagactgcaaaaatccgggccaaggcccctaaagggaaccggggaacccccacctttggtccccttaatgaagggtaaattcccccctggccgaaaccagggccaaaccggttcccgggggaaaatggtaacccccccccaa

SEQ ID NO: 91 - DNA, 587 bp, Gossypium hirsutum
atgagttgagcaagaattatatgtgagcgtgatcatttgatcagagaaatgaagttgaaggattcaattttgctggacttgcgataatctgagctcaggtctcgtatgtggtcagattgacccaggttgtgtatctatggaaaaccttgttccatcggtcatgagtaggattgaagtccttgcattagagggtttgagaattcaatgtggcatgtcagacgaggatgcaccatcaagcatcagtcctttttcctcaagcaacatgccatttattgtaggcaaggattcaaatttcagtaagttactcagttttgagggagctgcaagttcaaattccctggacctggattttgaatatgattttgattatgttaatagattaatgagcctttccataacattggatgagtggttacggctggacgctggcattatagaccacggagaccatattagtgatcataagatccagatccttgaggctcatcaagccaagtgccttgattcagttagtggaaaattgataaaacgtgttaacttaggtaaagcatctggtagacagcatgggctgttggggaacaacttta

SEQ ID NO: 92 - DNA, 901 bp, Gossypium hirsutum
  misc_feature (20)..(20): n is a, c, g, or t
cgcagatagaattcctcaantggcgtaccacaaagagtcgaaaatggaggagctggcccacaagatccacagcaagatctcctcgccgtcatcctcctccgattccgacgacgataagcgctctcacgctcgtgccgtcgctctcaaggccaaagctttatcgtctcttcggcagagaaaagcctcttcaccaagtcttaggcgccggaaaacctgctgatatccttctatggaggaacaagaaactttccggaggcgtgcttggtggtgtaacatctctctggtttctctttgaaatgcttgattaccatttaatcactctgatttgccacttaatgatactggcattatcggtccttttcctatggtccaatgcgtctaatttcatcaacaattctccaccaaccattccagaagttgtaatccctgaaaagtggtctccttaaagctgcatcttgctttacgtttgaaattaaccgaactctggatattgtacggaccattgcaaccggcaaagatttgaagaagttacttggtgctattgctggactatggtttctgtcaattctgggtagctgttttaacttcttgacgatggtctacatagtatatattcttctatacactgtgccggtattttatgagaagtacgaggacaatgtggatgcattttctgagaaaatgataatagagcttaagaagcagtttgcagtgcttgagaagaaggttctgagtagtatcaataaagagaagaagaaagattagtgtttgttttttttttggctgaaatcaattgtttgattgtattttttacctctcatcatctttgagtcccccctgttttaacattgcacatatcctcgttgaatatggttttcaacaatgtcttagtttttagatc

SEQ ID NO: 93 - DNA, 960 bp, Gossypium hirsutum
ggcagagaaaaaaaggagagacaaagattatggaacatgatgatatgttcatggggaaccgaagccaaactggtaataagtataaccccaacaatgcaaccaccaacagtttcaacttcgagaccacgctcactgagtctcacgcgctgaaccacccgcaccaacaacaacaacgatactctctttacgccggcgatgggtcgagtcgtattcaccaatcggcagatcctcatcttgtttgtttgaagcttgggaagagacattactttgagggttcaacagatctgaacaacaatcgtcactccgccggtgggttctctattggaaagaaaggtaaaccctattatgataatcttagcggcgaaggaggtggaccttcttcgtcgacgggaccgaggtgtcaagttgaagggtgtaatgttacactagtcaacgctaaagactatcaccggagacataaagtttgtgaaacacactctaaagcacccaaggtggtggtgttagggttagagcaacgcttttgtcaacagtgtagcaggtttcatttagtgtcagaatttgacgactctaagaggagttgcagaaggagattagcaggtcataatgagcgtagaagaaaaacctctcaagattctgctaccaggaactttgctcatgataataaaccgatgactgggagttttccgtatgtatcgtcgccaacaggacgtgctctctctcttctgtcatccaaggttgattcttggatctccccgtctaatctctccacaagatctagtgccgccttgcgtgagctgattgtggaaaaccgtgctgctgtcctcgcacggcagctcgtactcgagcgtgactggcactatataggtgagccccagcctgcagggtccaatcctatattagttcagcatcactcaatgcttgaccctcatcgttgggactttccgttcccggaaatcggtg

SEQ ID NO: 94 - DNA, 1632 bp, Gossypium hirsutum
  misc_feature (1468)..(1468): n is a, c, g, or t
tcaaatccatatcttttacaaatcctacagtacccttgtatccacgccttgctcaagggaagtcttggaatgaaatgactgtaacctggacaagtggctatgacatagatgaagcagtgccgtttgttgagtggggtagaaaaggagatttgcaagttagatctcctgcaggaactttgacatttaaacagaacagcatgtgtggttcacccgcaagtacagttggctggcgggatccaggtttcatacatacaagtttcttgaaagatttatggccgaacttcgtatacatgtacaggataggtcatctcttgtataatggttcaaatgagtacagtgattatcagcctggttcactcaatactactgaccaactgataagggacttggacaacattgacatagttttccacataggagacttgacctattcgaatggatacatttcacagtgggaccaatttacagcacaggtggagcctatagcgtcaactgttccctacatgattgcaagtggtaatcatgaacgtgattggccaaactcaggatcgttctatgatactccggattcaggtggtgaatgtggtgtgccagcagaaaccatgttttattatcctgctgagaacaaggcaaagttttggtactctacagattatggcctatttcacttctgcatagctgacagtgaacacgactggagagaaggatcagaacagtacgggtttattgagcaatgccttgcatctgtagatagacataggcagccttggttgatcttttccgctcatcgtgtccttggatattcatctaatgactggtacagccaggagggcgcatatgaagagcctatgggaagggatggtttgcagaaactttggcagaagtacaaggttgtacattgccttctacggccatgtccataactatgaaagatcatgcccaatctaccaggtaagaattgcaaatactgagagatcctcaaatctgcagtgtcaaactaaatcccgggattcttgtatctgttaccataacagttaccctgtgtagggaacagttggatagtatattataagcacaaataatctcactaatttttgtggcatatgctttgtgcagaatcaatgtgtgaacaaagaaaaaaatcattactcaggcactgtgaacggaacaatccacgtcgttgtaggtggagcagggagccatcttttgaaattcagccaactcatcccatattggagtatttatagagattatgactttggatttgtgaagctaacagcatttaaccagtcatccctgttatttgagtataagaaaagccgtgatgggaaggtttatgattccttcactatttcaagggactataaagatgtcctggcttgtgttcatgatggctgtgaacctacaacattggcatcttgatcaaatatcattaggggaagtgtatgttgttagtggaatgatttanggagagtttggagttaaaaaaaattgtattgagaggttaaaatagatgagacctcctccagttattggttcaatttattggactggttgaatctaaaatataaattaaatttttgttactaagaacatttttaacattcaaataccattgcttatgcttatatt

SEQ ID NO: 95 - DNA, 1057 bp, Gossypium hirsutum
ggcagaagctgccgcagctgctggtgaaagcagtttcaaatctttcatggttgcagtacaacgtgctggcagtagtgtggccatagttcagcaatactttgcaaattctatatctcggctcttattgcctgttgatggttctcatgctgccgcttgcgaagaaatggcaacagcaatgtctagcgcagagggtgctgcttttaaagggcttcatcaatgcattgaaactgtgatggctgaggttgaccgattgttatcagctgaacaaaaggcagcagattaccattcacctgatgatggaatggttcatgatcatcgtccaacaaatgcctgcacaagagttgttgcttatctttctcgggtccttgagactgcattcactacattagagggtcttaacaaacaagcattcctgactgaactgggaaattacttgtacaaaggactagttaaccattggcagaagttcacttttaatccgagtggaggactacgactgaaacgtgacataacagagtacggagaatttgtgcgcagttttaatgcccctactgttgatgagaaatttgaactccttggcatcttggccaatgtattcattgttgctcctgaaagtctctcctctttgtttgatggtaccccgagcatccggaaagacgcacaaaggtttattcagcttagagatgactacaagagtgcgaaactagcatccaggcttagctccttatggtccagttgaggggacttccctggttttccttctacttgcttgatcccatcaacagcagctcccaggttttgtttattcgacacaaaatccactacattagattccatttcttgttcatattcttcagtgtttcttttttccatatatgtaagagttgaggactttgttaataaccagacagtggttgaaccaattgtatgttcagttcttggttcaataagattttagctattacgaatttgcgtttaacatctatgctatttatagattgctcgattgggtctataaatgaataaaaaggatatcaattattcccaaaaatacttg

SEQ ID NO: 96 - DNA, 1395 bp, Gossypium hirsutum
catacgcaactttggggacaagaagagcacgcatcttccaattatatctacaaatcattaagcctcgctctgcaatttccccctttttacccttccaccactactacaacaaagccgccatttcagtcgctgacccaaccacaccgacgaaaccataatcaatggctgccgcgttacaattacaaacacacccttgcttccatggcacgtgccaactctcacctccgccacgaccttccgtttccttcccttcttcctcccgctcgtttccatctagcagacgttccctgtccgcgcatgtgaaggcggcggcgtcgtctttgtccaccaccaccttgcaggaagggatagcggagttttacgatgagtcgtcggggatttgggaagacatatggggtgaccatatgcaccatggatattacgacccgggttccgatgtttcgggttcagatcatcgtgccgctcagattcgaatggtcgaagaatcgctccgttttgctggaatatcggaggacccagcaaacagacccaagagaatagttgatgttgggtgtgggataggaggcagttctaggtatctagcaaggaaatatggggcaaaatgccaaggcattactttgagccctgttcaagctggaagagccaatgctcttgctaatgctcaaggactagcagaccaggtttgttttgaagttgcagatgccttgaaccaaccattccctgatgaccaatttgatcttgtttggtctatggaaagcggagaacacatgcctgacaaacccaagtttgttaaagagctggtgcgagtggcagctccaggaggcacaataatagtagtgacatggtgccatagggatcttggtccatctgaagagtctttgcagccatgggagcaaaagcttttaaacagaatatgtgatgcttactatttaccagagtggtgttctacttctgactatgtcaaattatttcagtccctatctctccaggatataaaggcaggagattggactgagaatgtagcacccttttggccagcagtgatacgttcagcattgacatggaagggcttcacatcgctgctacgaagtggattaaaaacaataaaaggtgcactggtgatgccattgatgatcgaaggtttccagaaaggggtgataaagtttgccatcattgcttgccggaagccagctgagtaggccataacccaaatcttaatttctaccgtaattcatccgctcaaatttgtgtcaatggtgaagattctatattacattgctttaaacatcccttatggtgtaagcgaaaatgagcaaataaagttgtatgcaaaactgatgccactgcaatacgtatggagttttgaataaattgtttgttccatttctaagtctt

SEQ ID NO: 97 - DNA, 627 bp, Brassica napus
gtcatgacggcgttgtcaggactcttgccgagcataagcttttacctcggatcatcgccggctctagcgtcggctcaataatctgctccgtcgtggcgtcaagatcctggccagaactgcagagcttcttcgagaactcgttacactctctccagttctttgaccagctaggaagcgtcttcacgatcgtgaaacgcgtcatgacgcaaggagcgttgcacgacattagacagctgcagtgcatgcttaggaacctcacgtgcaacctcacgttccaagaggcttatgatctgacggggaggatactcgggataacggtttgctcaccgaggaagcacgagccgcctcggtgtcttaactatctcacttctcctcacgtggtgatatggagcgcggtgactgcttcttgcgctttccctggtttgtttgaagctcaggagctgatggctaaagataggagtggggagatagtgccgtatcatccgccttttaatttggaaccggaggaaggtggggataagtcgtctacgaggaggtggagagatgggagtttggaggttgatttgccgatgatgcagcttaaggagctgtttaatgttaatcattttattgtgagccaggctaatc

SEQ ID NO: 98 - DNA, 2391 bp, Ricinus communis
atggatataagtaatgaggcaagtgttgatcccttttcaattggaccctcaacaatcattggtaggactattgctttcagagtcttgttctgcaagtcatttgctcatttgaggcgtcaaatttatcatgtgctagtgtattacatttatagatttagggatgtttctgcttccatgttgtcttggttgcatccaaggaatccacaagggatattagccatggtgacaataattgcatttctattgaaacgatacacgaatgtaaaattaagggctgagatggcttatcggaggaaattttggaggaatatgatgagaactgcattgacatatgaagaatgggcccatgctgctaagatgcttgataaagagactccaaaaatgaatgaatgtgacctttatgatgaagaactagtgagaaataagcttcaggagcttagacatcgtcgacaggagggatcacttagagatattatcttttgtatgagagctgatctcataagaaacctaggtaacatgtgtaacccagcccttcataagggtaggcttcaagtgcccaagctcataaaggaatacattgatgaggtctcaactcagttgagaatggtttgtgattctgattctgaggagctttcacttgaagaaaggcttgcttttatgcatgaaacaagacatgcatttgggagaactgctttgctcttgagtgggggtgcttcccttggagcctttcatgtgggtgtggtaaaaacattagtggagcataaactcttgcccagaatagtcgctggttcaagtgttggatccattgtatgttccattgttgccaccaaatcatggccagagctgcaaagcttttttgaggattctctgcactcattgcagttttttgatcagattggtgggctttttactgttgtgaaaagggtcgcaacacaaggggctgtccatgatattcggcagttgcagtggatgttaagacatctcacatctaatcttacatttcaagaagcttatgacatgacaggtcgaattcttgggatcacagtttgctcccctagaaagcatgagcctcctaggtgtcttaactacctcacttcacctcatgttgtcatatggagcgctgtcactgcttcttgtgccttccctggtctttttgaagctcaggaattgatggcaaaggacaggagtggagaaattgttccatatcatccacccttcaatctggatccagaagaaggatcaggagaatctgcacgtaggtggagggatggtagcttggagattgatttaccaatgatgcaattgaaggaactgttcaacgtcaatcactttattgtgagtcaggcaaatcctcatattgctccgttgttgagaatgaaggagtttgtgagagcttatggtggtaattttgctgccaagcttgctcatctcactgagatggaagtaaagcatagatgcaatcaggtactggaacttggttttccattaggaggacttgccaagctttttgctcaagaatgggagggcgatgtcactgttgttatgcctgccacagtgtctcagtacttgaaaataattcaaaatccaactcacatggaacttcaaaaggcagccaaccaagggagaagatgcacatgggagaaactttcagccataaaagctaactgtggcattgagctttgtcttgatgaatgcgttgcaatcctcaaccacatgcgtaggctcaaaaggagtgctgagagagctgctgctgcttctcatggtctaaccagtacagttgccagcactgtcaaatttagtgcttctagaaggattccttcttggaactgcattgctcgagagaactcgacaggctcacttgaagaagacctccttgctgatgttgcttccacattccatcaaggtgttggtggatctggagcagctggaactactggtagaaatatgcggacccaccgttatgtgcatgatggaagtgatagtgaatcagaaaatgctgatttaaattcctggacaagatctggtgggccattgatgagaactacttctgcaaataaatttatcgacttcgttcagaatctggatgttgataccgaattggcccgaggcttgatgagggattgtagcaataggccatctctgaatagctctagtattacagtcgctgaaggtgatcttttgcaaccagaaaggactcataacgggtttgtgttgaatgttgtaaagaaggaaaacctggcaatttccaagaggaccccagacttagaaaactacaacagtgaagttccggaatgtgttcagcttgactgcccagacagggatatggatgcgagctcagcatctgattatgctggcgacgatgatgacgatgacaatgatgatgatgtcact

SEQ ID NO: 99 - DNA, 1621 bp, Populus tremula x Populus alba
agcttgctcatctcgctgagatggaggtaaaacatagatgcaatcaggtattggaacttggttttccattaggtggacttgccaagctttttgctcaagaatgggaaggtgatgttactgttgttatgcctgccacactcgctcagtactcaaaaattattcaaaacccaaatcacttggagcttcaaaaggcatcaaaccaaggcagaaggtgcacatgggagaagctttctgccataaaagctaattgtggtattgagcttgctcttgatgagtgtgtttctgttctgaaccacatgcgtagactcaaaaggagtgctgagagagctgctgctgcttctcatggccaagcaagctctgcgagcacattgagatttagtgcttcaaaaagaattccttcttggaattgcatcgcaagagaaaactcaacaggctcacttgaagaagacttccttgctgatgttgcttcaacattccatcaaggagttggtgtggctggaggaacttctactggtaggaatttgagaacacaacgcaacctacatcatgatggaagtgatagtgaatctgaaagtgtagatttgaattcttggacaagatctggcgggcctttgatgaggactgcttctgcaaataagttcattgactttgtccaaagtctggatgttgattctgagctaaggaaaggcttcatggctcatcctaactcgcctggggctcagatgggaggcagggatccatataatcagatctcaagagtgacaaccccagatagaaattcagaaagtgagtttgatcagagagattttagcaatagaaattctactggtggttctagcattacagtcaccgaaggagattttttgcagcctgaaagaatccataacgggtttgtgctgaatattgtaaagaaagaagatttggcacatcccaataggatccatgatttggagaattacaatagtgaagttcctgaatgtgttcagcttgattgtcctgaaaaggacatggatgctagctcagaatcggactatgctgcagaggaagacgactcccctgcaacagattccttgcataaatcagcttccactcttgatcacacagatgattctgtcgttcatgacattcaggagaagcatgtcgtggatggttaactttgagtttcttctgcattactgtaccaaaatattgggtggagttgattcccgggttactgtcaatcaaaggtttccgactttccgtcactggagtcacaactggagtatcatagacgagatttagaatctgtttattttttattttaaaaatatttttgaaaaaaattttgattttattttgattttatttttgttttaaattaatatttttttggtgtttttcatattattttgatatgttgatattaaaaataaatttttaatatcaattattcaatcagatatatttttaagtaaaacaagacagtttgaaaagtaatcggaacttttaaaaggttgctcttagtagtgaattataaaaaacaattgaaagcaatctggcagcgtcaggctattgctgttgtaaactaattttgtgcgcatactatgcaacaattgtaatccacatgcttagatttcagcca

SEQ ID NO: 100 - DNA, 613 bp, Hordeum vulgare
accctacatctctccactcctccgaatgaaggagatcgtcagagcttatggaggccgctttgcaggaaagctcgctcgtcttgctgagatggaggtgaagtatcgatgtaatcaagttctggaaattggcctcccactgggaggacttgcaaagttgtttgctcaggattgggagggtgatgtcaccatggttatgccagcaacagtagctcagtacttgaagattatacaaaacccaacatatccggagctccaaatggccgccaaccagggccggaggtgcacatgggagaagctgtccgcaatcagagcaaactgtgcaattgaacttgcattggatgaatccatagcagccctcaaccacaaacgaaggctaagaagaagcattggaagggcagcagcttcttcccaaggatataccgacaatgttcgacccaaaacaccaaggagggtaccatcatggagctgcatcagcagagagaattcgtcgggatctctctcagaggatcatttcgcggccgccatttcatccagtcaccaaggtactattcgagttgatgctgcaccaagcacgtctcatcatgttcgtaagagttcagttgatggaagtgag

SEQ ID NO: 101 - DNA, 638 bp, Brassica napus
gatccacaatcaacaatccacaagatgggtaaggaagacaatcaaggagaagagtacctcttcaagattgtcctaatcggcgactccgcggtcggaaaatcgaacctcctgtctcgattctctcgtgacgagttcgacaccaactcgaaggcgacaatcggagtggagttycagacgcagctggtkgagatcgaagggaaagaagtgaargctcagatctgggayactgctggtcaggagaggtttagagyagtcayttctgcttattacagaggtgctttcggtgctctcattgtctacgacatcacyagaagctccactttcgagagcgttaaacgatggyttcargaactcaacactcattgtgatacagcagtggcgcaaatgctagttgggaacaagtgtgatttggaggatataagagctgtgagtgtggaagaagggaargctctygcggaggaagaaggattgttcttcatggagacatctgctcttgacgctacgaatgkagacaaggcytttgagattgtcatcagagagattttyagtaatgttagsccgcaayttctcamytccgatgsttacaaggctcagctttctgttaaccgggttagtcttgttaacaacagtgttggcgc

SEQ ID NO: 102 - DNA, 1030 bp, Solanum lycopersicum
caaaaacactattttaagtccatcaataatgtcattacttcctctcttttatatatagtgccataaccttcagcccctttatttatttcaacatctttgtcacagtagtgggagagtagagtagcttaagtagttccgaccgacaaagaggagaagaaaaatggaggaagaacaagagtatcttttcaagattgtggtgattggggactctgccgttggcaaatccaacttgctgtcccgttttgcccgtgatgaatttgaccataactctaaggccaccattggagttgagtttcaaacacaagttgttgaagttgatggtaaggaaattaaggcccaggtttgggatactgctggtcaagaacgttttcgggctgtcacttctgcttattatagaggcgctgttggagctcttattgtttatgatatcagtagaagcacaactttcgaaaatatcaaacgatggcttgatgaactcaacacccactgtgataccacagttgcgagaatgcttgttgggaacaagtgtgacttggagaatatcagagatgtgagtgtagaggatggaaaaaaccttgcagaagaggaaggattattcttcattgaaacatcggctctcgactctactaatgtgaaaacagcctttgaaattgtcatccgtgagatatacaaaaatgtgagcagaaaagtactcaactctgattcatacaaggcagaattatctgtcaatcgcgttagccttgccaatgggaccgacatgtcaaagcaaaaaacgtcgtgctgttccagctagttttgttccataactcattatgttgatcttttctctctctttacctttctattcttctctgccctcaatttaagctgggcagttgctcaagggtgtgtcttgtttgcgtttagttaattgttgtatcacttgcagtcttgcaactaaggggagcagtacacaataacccccaataggttataattgtatttttgagaaataattaactcatcaaattctattcgagaggtattgcac

SEQ ID NO: 103 - DNA, 657 bp, Ricinus communis
atgggtcaggatcaaggaggagggggaggcgaagagtacttgttcaagattgtattgataggtgactctgctgtagggaaatctaatttgctcgcgaggtttgcaagaaatgagtttgacagtaattcaaaagctacaattggtgtagagtttcagacccaggtagtggatattgagggtaaggaaatcaaagcacagatctgggatactgctggacaagaaaggtttagagctgttacttctgcttattatagaggtgccgttggtgctttaattgtttatgatattactaggaggagtagttttgatagtgtcaaaaggtggctagaggaactcagtactcattgtgatactacagcggcaagaatgcttgtagggaacaagtgtgacctggaaaatattagagaagtaagtagagaggagggcaaaaccctggcagaagaagaaagcttgttcttcatggagacatcagcccttgattctaccaacgttgaggctgctttcgaggttgttatccgtgagatctaccacaatatgagcaggaaaactctcaactcagattcatacaaggctgagttgactgtcaaccgagtcagtctagttaagaataacgcaaattcatcaaagcaaagtagcttctcttgctgtgctacatga

SEQ ID NO: 104 - DNA, 989 bp, Populus tremula x Populus alba
gaaagcaattctaaaagccccaacttctctagtcaaagccaccgccaaaatccatcacaaaacagctccgccaattacgcagccagtctgcacctgtctcagtgcaaatgctagtcgcccctttcacacatcccaaaacgtaagaaaatcccatcactaactataataatccacgcgtaaaccaaagcaactccttcttgctgcaacaatgggtcgagaacaagaagaaggggaagggggtgaagagtacttgttcaagatagtggtcataggagactctgctgttgggaaatccaacttgttgtcaagatttgctagaaatgagtttgatagcaattcaaaggctacaattggggtagagttccagacccaagtggtggatattgatggcaaagaaatcaaggcacagatctgggacactgctggtcaagagaggtttagagctgtcacctctgcttactatagaggtgctgttggtgctctcattgtttatgatatcaccaggaggacgagctttgatagtgttaagaggtggcttgatgaacttggcactcattgcgacactgcgatcgctagaatgcttgtagggaacaagtgtgatcttgacagtatcagagaagtgagtagagacgagggcaagagccttgcggaggaagaaagtctattcttcatggagacatctgcccttgattctactaatgttgaagctgctttcgaggttgttatccgtgaaatctacaataatatgagcaggaaaatcttaaactctgattcatacaaggctgagctgacagccaatcgagtgagcctggtgaatggggacacctcgtccaaaaagtatggcttctcttgctgcaatacatagtctcttttctttctggagtgtaattcgagtccggtgtttgaattctttttgtcagatcggcgctgcattttacttactattatccttggcaacaagtataaaaatcatttaagctttttttcga

SEQ ID NO: 105 - DNA, 684 bp, Solanum lycopersicum
aaaacccactagaagtgtacaatttgctccactttgttgtttctcatggatctcatttccaatttgttctatggtcttcctttactatacatactctatttaatatggaagattatagatcgagagaggcaccaaaattgttacattttggactatgaatgtcacaagccaaccgatgatcgaatgcttagcacaaaattttcaggggagataattatgaggaacaaacaccttggcctaaatgagtataagttcctcttgaaagctgtcgttagttccggcattggtgaacaaacatatgcaccaagaatggtgtttgatggtcgtgaagcatgtcctacttatgaagatgggatattggaaatggaagagtttttccatgatagcattgacaagctcttcaagagaaacaaaatttcccctagtcaaattgatgttcttgtggtgaatatatccatgttagcttctatgccatcgatggctgcacgaataatcaattactataagatgagagaagacatcaaagtgtataacctcaccggaatggggtgtagtgctagcctcatatcactaaatatagttgaaaatatcttcaagaatgagaagaacaaggttgcacttcttgtgacatcaaagtccttgagtccaaattggtacgttgggaatgataaatctatgattctt

SEQ ID NO: 106 - DNA, 1468 bp, Ricinus communis
ctctctctctttccaactctttctttctttctttctttttatgatctctcaaatggatttgctaatgctactgtatggattcttgatcttgtactccctcttcctgctttttaagcgggctggtgggagaagagatcaagaatgttacattctagactatgagtgttacaaaccaactgatgacagaaagcttgacactaatttctgcggagagcttattacgaggaacaagaatctcggtcttaatgagtataagtttctcttgaaagcaattgtaagctctggcattggagaacaaacctacgctccaagaatggttttcgacggccgagaagaaaaccctacttttgaagatgggatcttggagatggaagaattctttcatgatagcatcgaaaaacttctgtccaggtcaggcatatctcctcaagaaattgatgtgcttatagtaaatgtatcaatgttatctgtagcaccttctttgtcctctagaatcataaatcgctacaaaatgagagaggatatcaggtctttcaatcttactgggatggggtgtagtgctagtcttatatctgtcaatattgcacagaacattttcaagtctcacaagaatgtttgcgcacttgttgtgacatcagagtctctgactccaaattggtattcaggcaatgatagatcaatgattcttgcaaattgtttgtttcgctctggtgggtgtgcgatgcttttaactaataaaagagcactagagcacaaagctatgttcaaactgaagtgtttagtaagaacacatcatggaggtagagatgagtcttatgaatgttgcctccaaaaagaagatgatcaaggaaggccaggttttcatctggggaagtcactcccaaaggcagcgacaagagcttttgtcgacaacctgagggagatttccccaaagatcttgccaataagggaactgcttagattctcaatcatgacattcataagaaaatggagccaaagccgaaattcaggcaaaggaggaggagcaacaacaccagcgcctaggccagtgattaatatgaggacaggagttgatcatttctgtatccatacgggtggaaaagcagtaatagatggaattggggtgaatcttgatttgtctgagtatgacttggagccagcaagaatgactctacatagatttggcaatacatctgcaagtagtctttggtatgtgttggcatacatggaagccaagaaaaggttaaaaaaaggtgataggatattgatgataagctttggtgcagggtttaaatgcaacagctgtgtgtgggaagttgttagagacttagaaaatagtaatgtgtggaaggattgcattgatagctacccaccaaaaaccttggctaacccattcatggagaagtatggttggatatataatgaagatgaaagcacctttgttcttcctcagtttgagaaaaattaa

SEQ ID NO: 107 - DNA, 932 bp, Populus tremula x Populus alba
aaataataatactggcacaccaaactgtcaagtcccatctctctctctgtttctttcaaaattaaacaatggatgttcccatgttagtatatgcttttctcatcttctatcccctcttcatgttatggaggcggattgataggaaaagggaccgagaatgttatatactagactatgagtgccacaaaccaaccgatgacaggaaacttgacacagagtgttctgggcaagtgatacggaggaacaaaaatcttggtctgaacgagtacaagtttctgttgagagctattgtgagctctggaattggcgagcaaacctatggtcccaggatcatattcaacggtcaagaggagaaccctacattacaagatttaatttcggagatggaggagttctttcatgacagcatcggaaagctcttggctaggtcaggcatagctcctaaagaaatcgatgttcttgtagttaatgtctccatgcagtctgttgtgccttctttacccgctatgatcataaatcactataaactaagggaggatgttaaggtttttaacctcactgggatgggttgtagtgcaagccttatatccgtcaacattgttcaaaacatttttaagacttacaaaaatgcttatgcgcttgttgtcacctcggagtctttaagtccaaattggtatgcaggcagtgatagatcgatgattcttgcaaattgtttgttccgatctggtgggtgtgccatgctcttgactaacaaaagggccttaaagcaccgtgccatgctcaaattgaagtgcctagtcaggacacaccacggagctatagacgagtcgtatgattgttgccatcaaagagaagatgaccaagggcgctcagggtttcacctggacaagtcactcccaaaggtcgctacacgagctttggtcgacaacctt

SEQ ID NO: 108 - DNA, 684 bp, Populus tremula x Populus alba
ctctctctctctctctctctctctctctctcacacacacacacacacacacacacacacacacactcaacaatggattttctcttgttagtatatgctttcctaatcttctatcctctcctcgtgttatggagggggattgataggaaaagggaccgagaatgttatatactagactatgagtgctacaaaccaacagatgacaggaagcttgacacagagttttctgggaaagtgataatgaggagtaaacagcttggtcttaacgagtacaagtttctgttgaaagctattgtgagctctggaattggggagcaaacctatggtcccaggatcatgttcaaaggccaagaggaaaaccctacattacaagattcagtttctgaggtggaggagttctttcatgacagcatcgaaaagctcttggccaggtcaggcatttctcctagagaaattgatgttcttgtagttaatgtctccatgctgtcttccgtgccttctttagctgctaggatcataaatcactataaactaagggaggatgttaaggtttttaacctctctgggatgggttgtagtgcaagccttatatcagtcgacattgtccaaaacgttttcaagagttgcaagaatgtttatgcgcttgttgtcacctcggagtctttaagccctaattggtactcag

SEQ ID NO: 109 - DNA, 930 bp, Hordeum vulgare
cggcagagggacgacgcgcacgccgcagccgtgcactgcgaggacgccgacgggcggctcggcgtcagcctcagcaaggcgctccccaaggccgccgtgcgcgccttcagcgagaacctccagcgcctggcgccgcgcatcctgccggcggccgagctcgcgcgcttcaccgtccgcctcctggcgcgcaagctgatgcgccggaagctcaagttcgagggcccaaagatcaacttcaagacgggggtggaccacttctgcctccaccccggcgggacggcggtcatcgaggcggtgaggaagaacctggggctcaacagctacgacgtcgagccggcggccatgacgctgcacaggtgggggaacacgtcggcgagcagcctgtggtacgtgctgtcctacatggaggccaagcggcggctgaaagcaggggacagggtgctcatggtgaccttcgggtccgggttcaagtgcaacagctgctactgggaggtgagcaaggacctcgacgacgccggcgcctgggaagactgcatcgacgactacccgccggagaccatggtcaacccctacacggagaagttcggatgggtcaacgacctacagtgccagggaggcgccttcccgttctaacctccaaatgctttgattttaccttggataaattattattgattatttcagagataaaaaaaatttatcagtagaaaattatatttaaaccaaggggtgtgtgtgtatggtggtcttctttcttttcgaaatttctgttcgtcctgttgatacgaatttacgtacacttgtaaatagttagtctggatacgtgtgtgtacgattgtacgtggatccacacgatggatcttgttccgaacaaataaatgttcgggtatacttggaagaaataaaaagtaaaaacagagtgtgcacaag

SEQ ID NO: 110 - DNA, 2364 bp, Ricinus communis
atggctcctagcttaagcaaagctaattctggtcctgaaggactggttgttgagagctatgatattaatcatagtaaccaatttgtaatctcacttgaagattcaaacctcaaagccaatggccatgtctttctctcttgtgtccctgataacatcacactcactccctctcgttatgccctcacagacaaatcatcaactaccgtcggatctttcatcgggttcgactcgatggaatccaaggatcgacatgttatttccataggaaaactcaagaacataaagtttatgagcattttcaggttcaaggtctggtggactacccattgggttggctctaatggccgagaccttgaaaatgaaactcaaatgcttattcttgataagtctgactctggccgtccttatattctactactccctctgcttgagggtccattccgggcatcattacagcccggaaacgacgataacattgacatttgtgtcgaaagtggatcgacgaaagtgttggcggctggattccagagtgttctttacgtgcatattggcgatgatccgtacaagttagtaaaggatgcaatgaaaattgttaaggttcatttaggtacgtttaagctgttggaggagaaaaacccacctggaatagtcgataagtttgggtggtgtacatgggatgcattttatcttactgtgcatcctcaaggcatttgggaaggagttaaaggtcttgttgatggtgggtgcccacctggtttagtgttgattgatgatgggtggcaatctattagccatgatgaggatcctattactaaagaaggtatgaatgctgctgtagcaggcgagcagatgccatgcaggctattgaagtttcaagaaaattacaaatttagagactacgtcagtcctaaaagtttggccaatggcagtactgaaaacaaagggatgggtgcttttattaaggaccttaaggaggagtttagcagtgttgattatgtgtatgtttggcatgctctctgtgggtattggggtggcctgaggccaaatgtgcctggactgccggatactgtggtggttaagccaaaattgtctccgggactggagttgactatggaggatctcgcggtggataagattgttagtactggcgtggggttggtgccgccggagacggttgagcaaatgtatgaagggctccactcgcacttgcaaaatgttggaattgatggtgtcaaagtagacgttatccatttgctggaaatgctgtgcgaaaactacggagggagagtagacttagcaaaggcatattacaaggcactgacagcctcagtaaggaagcatttcaacggaaatggcgtaatagctagcatggaacactgcaatgatttcatgttccttggtactgaggcaatttgtcttggtcgtgttggtgatgatttctggtgcactgatccatccggtgatccaaacggcacgttttggctacaggggtgtcacatggtgcactgcgcttacaatagcctgtggatgggcaacttcatacatccagattgggacatgttccaatctactcatccttgtgctgaattccatgctgcttctcgggcaatttctggtggtccgatttacgtcagtgattctgttggaaagcacaacttccctttgcttaagcgtctcgtgttgcccgacggctccattctccggtgccagtactatgctcttcctaccagagattgcctctttgaggatccccttcacgatggcaagacaatgctcaaaatttggaacctcaacaggtttactggagtcattggagtatttaattgtcaaggaggaggatggtgccgcgagactagacgcaacaaatgtgcctctcaattttctcatttggtgactgctaaaaccaatgctaaagacattgaatggaagaatggaacaaatccaaattcaattgaaggagtacaagtatttgcaatgtacttattcaaggccaagaaactactactttctaagccatatgaaaacattgaaatcgcattagaaccattcaatttcgagcttattactgtgtcgccagttgttactttatcagaaaaatccattcaatttgctccaattggtctagtgaacatgctcaacactggaggtgctatgcagtcattgtcctacaatgccgatagctcgatagaaatcggagtgagaggagagggagagatgagggtttttgcatcggagaaaccaagagcttgcagaatcgatggaaaagaagttgagtttgagtatgaagagtgcatggttgtcgttgaagtgccatggtctactactaactcttccggtgtttccaacgtcgagtacttgttttag

SEQ ID NO: 111 - DNA, 906 bp, Populus tremula x Populus alba
tgccgcttctagggcgatttctggaggtccaatttatgtcagtgatgctgtagggaagcacaactttccgttgctcaagaggctggtgttgcccgacggttcaattctccggtgtgagtaccatgcacttccaaccagggattgcctctttgaggatcctctgcatgatggcaataccatgctcaagatttggaacctcaacaagtttactggagttgtcggagcatttaactgccaaggaggaggatggtgccgcgagacaagacgcaaccaatgtgcatcccaattttctcacctggtgactgctaagaccaaccctcgagacattgaatggagcagtggcaagaacccagtttccatcgaaggagtacagatgtttgcaatgtacctgtcccagtctaagaagttggttctctccaagccagacgagaacattgaaattgcactggagccgttcaattttgagcttattacagtgtccccagtcaccatcctagctggaaaatcagtccattttgctcctataggtttggtgaacatgctcaacactggcggtgctatccagtcactggcttatactgatgatgccaagagcacagtccagattggcatcaagggaagcggagaaatgagggtctttgcttcagagaaaccaagagcttgcaaaattgatggaagagaggttgcttttgagtatgaagaacacatgattaccactcaagtgccatggtcttctctatctggcctatctattgttgaatatttattttagagttaaagtttttttaaaaaattttgagggacatattattatcaataccctccaaattaaataggaaaatgtaaagaattatcaactcttgttatcaatagctaattattacaataaacaatgttattgttatt

SEQ ID NO: 112 - DNA, 678 bp, Sorghum bicolor
aatccgcaaaagcccaagctttagcacaaggcaaaccaaccaaacactaataaaccaacgcaattctctagagcactctaggtcgccaacaagcgccatcgccatggctcccaacctcagcaagacgacgcctgctgctggcctccctctcggcgacgaggtggccccggtggagggcctcaagccgtcacggttcaccctcaagggcaaggacctggccgtggacggccacccgttcctgctggacgtgcctgccaacatccggctcaccccggcgtcgacgctcgtgcccgccgcccccgcgccggccggcaacggcagcttcctcggcttcgacgcggcggaggctaagagccggcatgtggtgcccgtcggcaggctccgtgacatccggttcatgagcatcttccgcttcaaggtgtggtggaccacccactgggtgggcgacaacggccgtgacgtggagaacgagacgcagatgatggtgctcgaccgctccgccgccgccggcgagcctggcagcggccgtccctacgtgctgctgctccccatcatcgagggctcgttccgagcctgcctggaggccgggaaggtggacgactacgtggacctgtgcgtggagagcgggtcctcgtccgtgcgcggcgccgcgttccggagcgcgctgtaccttcacgc

SEQ ID NO: 113 - DNA, 1020 bp, Brassica napus
ggagattctcaaagatctaarcctcttcwttttcaaaacatggrcmgatccatatttmtttctctagcactagcctcactcttggtcggagtcgtctcagctcgtgactggaacatcttgaaccagctcaaaggactgtcgtcatcrtcaagccaaaacggtattgtttcttcaggggtctcgacgaacctgaaacggtactgcgaaagctggaggatcaacgtggaagtycayaacgtsagaaacttcgatgtggtgcctcaggagtgcgtgtcgcacgtcaagaagtacatgacgtcgtcgmagtacgargaygacgtggagagagcmgttgatgaggtcatmcttcatttcgggagcatgtgttgtaccaaaacaaagtgtgatggcatggatgcttggatctttgayatcgatgacacgcttctctctaccattccgtaccacgagaagaatggcttctttggaggagagaagttgaactctacaaaatttgaagattggatgaggaagaggaaagcaccaccagtgccacacatggtgaaactgtaccatgacatcagagaaagaggcatcaagatcttcttggtctcttcccggaaagaatatctcagatctgccaccgttgacaacctcatccaagccggttactatggctggtccaacctcatcctcaggggaatagaagatgagcacaaggaagttaaacagtacatgtcagagaagagaacatggctgatgggtcttggttacagagtatggggagtgatgggaagccaatggagcagcttcgcaggttgtcctcttcccaagagaaccttcaagctcccaaactccatctactatgttgcctgatcattacagtgcaaaactttgatccaagcttcttgaaacaagaagaagaatcgataaatatgagagaacggttttgactgtgatttttatttttgtttttccttttcgagtcatcttatatcaagagacttatgaataaaaaaagtgtttcttttcggtactaac

SEQ ID NO: 114 - DNA, 819 bp, Ricinus communis
atggcaagaaacttagtgttcatattggctttgacaagcctctgcattagcctagtagcagcagattggaacattttgaaccaaaaaagaagaaatgggttcaaatcagaatcaacatctggcttgaagaattattgtgagagttggaggatcaatgttgaactaaacaacattagggaattcaaagttgtgccacaagaatgcattgcatatatcaaacactacatgacttcttcccagtatgaagctgactctgaaagagccattgaagaggttaagctttaccttagcacttgctgtcatttacaaagtgatggtaaagatgcttggatctttgatgttgatgatacccttttgtctactattccttactacaagaaacatggttttgggggagagaagttgaatacaagcttattggaagaatggatgaaagaaagcaaggcaccagctttagagcacaccctcaagctcttccatgtaatcaaagataaaggagtcaagattttccttgtctcctcaagatctgaaaccttgagatctgccactgtagataaccttatcaatgttggttatcatggatggtctagtcttattttaaggggtcttgaagatgaattcacgaatttgcaagaatacaaatccaaggcaagaaaaagattgatggatgaagggtaccgcatatggggaatcataggagatcagtggagcagtattaaaggtcttcccagtgcaaaaagaacattcaagctgccaaattccataatcccaagtcctccatcaccaccaccaccaccaccacccccacgaacaaaataa

SEQ ID NO: 115 - DNA, 1314 bp, Populus tremula x Populus alba
agacaaggtcacatgagagttgagattatgagcagtgaaacattaacataaatattccatgtgattttcaaagctagaacaggccacccataccccacagcacatgtgacgcgttccccccaccagctctacaaattcaatcacccctccccccatctctctgggcaagaaatggcaagaaatttggtgttcatactagctctgacaagcctctacattggcttagcagccgcagactggaatatcttgaacaaaaaatcgaaaagcagggatgcctctagcttgaagaattattgtgagagttggaggatcaatgtcgagctaaacaacatcaaggattttgaggtggtgccacaagaatgtgtagatcacgtcaaacattacatgacctcgtctcagtacacagcagactccgagagggcgatcgaggaagtcaggctctacctcagcagttgctgtactttggaaggtgatggcaaagatgcttggatttttgatgttgatgacactctcttgtccaccataccttactacaagaaacatggttttgggggagagaagctcaatgcaaccttattcgaatcatggatgaagcaaggcaaagcgcctgctctagaccatacactcaagttcttccatgagatcaaaggcaaaggggtcaaaatctttcttatttcctccagaagtgaaacccttagatcagccactgtcgagaatcttatcaatgctggataccatggatggtccagcctcatattgaggggtcttgaagacgacttcatgaaagtgcagcaatacaaatccgaggcaaggagagcattgacaaaagaaggataccgcatatggggaatcataggagatcagtggagcagtgtggagggactccctggtgccaaaagaacattcaagttgccaaattccatgtactacctttcctaaagcttccactaccgacattattattccatatgttcaaccaggcattgtcattgtttatctgatgaaaaaaaccatgttaatctatgatttctttttgttaaaaaaaatctcagcttcgatcagatatctcaaatatctcagtaaaggaaatatgcttcagaataaggaagcaggttttgatgcttcgaacactacaatgggcaggtctagttgttgtcatgtcttacctccactgatagataaagccatcaagagttattttgattgcgatgcatgagactctgtttcgagaaaatcttgaagaacttggttggcatttcgtccgaatagagtgaaagaaaatgctgtttaaaaaataacctgtgtttatagcgt

SEQ ID NO: 116 - DNA, 871 bp, Solanum lycopersicum
atcggccgaattggcaattaaataaatcacagctaatccttgcccccctctctcttttttttgtctcccacataaatcataatacaatacaatactttgcttcctaccaacacatacattcacaaaaatgatgaaaactctacttgtttctctgtttctaatttcatcagtgactacatcatcatcttcttctgctagtgacattgtccgctcttcctgcgtgcacgccagctatcccacaatttgcgtcagaacactctcttcatactcggacacacccattaacaccccgcaggatttagctcaagccgcggtgaaaattaccctttctcgagcaggtaaagcgtctgggttcctgtctcgggtgaaagtggaaagcaaaagagagaaaggggcattgagtgattgtatcgaacagatgggtgactcgatggaggagctgaggaagagtttgtcagagcttaaacatgtacgcaggggaaatgcatttaagtggcaaatgagcaatttggagacgtgggtaagtgctgctttgacaaatgaagatacatgtcttgatggattcaaggaaattgatggcaaaatcaggtctgatgtgaaacgaaagattacgaatgttgctagagttactagtaatgcactttaccttatcaatcgactggatgattctgcaaacaaaattactcatccttgatcattaattcggttaattaacattaccgggagaaataatagcgagagcttaatgcatttggttgttctttcttctttttctgcggtaactatgcattttattggttagaaaccagtattattaatggtgcaatatttataaggtaagaaaagggaaattccaatttggccttgttct

SEQ ID NO: 117 - DNA, 971 bp, Ricinus communis
atgcatattagaccttcatggcctctgctatctggtagacgtgttcaatcgctattgggactttcaaacttgaaaaaggataaccttattggccaagactctagagtcctttgccttcgccagagcatgcaagagttagtatcactcgtacccgcacacagcaacagctccactcaaactgagcactggggaatgcctcctctattctctctcttcatccttttcctttctctctgctccgccgctgcaaaaacccacagcgcaggcgcggcaccacaagatctggtccattcatcatgcctccacgcgagttatcctaacctctgcatgcgcacactctcctcttactcaggcccagccaacaccccgcacgacctagctcttgcagcagtggaagtgagcctcgggcgtgccagtaaagtgtccaagtacttgagctcactatcgtctgggctaaaaacaaggaaagaacgagttgcgctgagtgactgcgtggagcagatatctgactcggtggatgagttgagtaatacgctaaatgaattaaagcatttgagaggggaaacttttaggtggcaaatgaacaatgctcaaacatgggtaagtgctgctttgactaatgaagagacttgtcttgatggctttgaacaggttcaaaggaaagttaagtgtgatgttaagagaaagattactaatgtggctagagttactagtaatgctttgtacatgattaatcgtcttggtgagagccgtggttagtttaattaggccttaaatagtgactcagtggattatggattgttaatctatcttcatcattacttaattattgttattattatatctgtatgggttttgtctatgtatttccttttttttttttttttttcaaaatttaatagttttgtagctatatttaaatgtaagatgtatgtatttacttgttaattattaatccaatttcatgctct

SEQ ID NO: 118 - DNA, 904 bp, Solanum lycopersicum
tggaataaattttggtgagagaaagaagtcgctgtatgtggcgctgctgagaaagaggcgagaggagcagcgatggaggacgacgttgagatggcagcgggggaaaacggcgccggggaattggatgacatgaagaagaggttgaaggagatggaagatgaagcagttgctctccgtgaaatgcaggccaaggtcgagaaagaaatgggctctgttcaagaccctgctgctgctgctgcaaaccaggcaaacaaggaagaagtggattctcgatccgtctttgttggaaatgtggattattcatgcactccagaggaagtgcagcagcattttcaggcatgtgggatggtgaatagagttacaatccgcacaaacaagtttgggcaacctaaaggatatgcttacgttgagtttgttgaatctgaagctgtccaagaagctcttcttctgaatgaatctgaacttcatggccgccaacttaaggtatctgcaaagaggactaatgttcctggtatgaagccataccgtgctaggcgtcctaacctgtatatgggattccgaggccgggcgccattcatgcctgctccatattttttccctccttttggatatggaaagattccaagggctagggcgccgatgcgttacagcccctacttctgagactgttttgtttttccgtagacgtacatacctctggatggtgggacatttcattaaaagcagtagctcttatcccctgtatggttgattgcctttacatatcttattaatccccaagttgagttttctggtgagctttgtggcaaatagtgtgatgatgaatccttttgggttttgtgtctttagaattgttgagaacatatgcatgtttggaatttctactgtaatgttgcattccacc

SEQ ID NO: 119 - DNA, 597 bp, Ricinus communis
atggaaggagaagatatggtgatggatgggacagagatcaacgaggaagaagtgcctgagcttgatgacatgaaaaagcggttgaaagaaatggaagatgaagctgctgctttgcgggagatgcaggctaaagttgaaaaggaaatgggttcttcacaagatcctactgctgctgcatctcaagcaaatagagaggaagtagattctcgatcagtgtttgttggcaatgtggactattcatgtacccctgaagaagtgcagcagcactttcagtcatgtgggactgtaaataggatcactattcgtacggacaagtatggccaaccaaagggctacgcatatgtggaattccttgaaccagaggctgttcaagaggctctccttctgaatgaatcagaattacatggccgccaactgaaggtaactgctaaaaggactaatgtgccagggatgaagcagtttcgtcctcgtcgacccaacccttacatgggatttgcgcccaggggttcacaactgcctccttatttctattctccgtatggatatgggaaagttcccagattcagaatgcctatgcgttacagcccctataactga

SEQ ID NO: 120 - DNA, 1012 bp, Populus tremula x Populus alba
attggtagtgttaactacattttggcatcaagaattgtgtgtcgctcgcattcttcaccgagagaactcgagaaggagggaggcagaatggacggtgacgatgtggacatggccgctgcagagaccaacgaatctgtaccagaacttgatgatatgaagaagagactaaaggaaatggaagatgaagctgctgctcttcttgagatgcaggccaaggttgagaaggaaatgggctctgtacaagatcctagtgcttcagctgctgcatcccaagcaaatagagaggaagtagattctcgatcagtgtttgttggtaatgtggactattcgtgcacccctgaagaagtgcagcagcattttcaggcatgtgggacaataaatagggtcactatccgttctgacaagtatggccaaccaaagggttatgcatatgtcgaattccttgaaccagaggctgtgcaggaggctctccttctgaacgagtctgagttacatggccgccaattgaaggtaactgttaagcggaccaatctacctgggatgaagcagtttcgtgctcgtcgacccaacccatatatggggtttccacccaggggcgctcctatgcctccttatctcttttctccttatggatatgggaaggttctgagatacagaatgccaatgcgttacagcccctatggctgaaatactattttgtttgaggcagcattgccagcagagagatacatctaacaaaatttgtactctcttttcttctcacatgttttaatcattgggaaagatgaacagaagatttttccctgcttgggttgacgcgttgaaatgtgagaattggagctttatgttgttcatggtagacaatgaaatcaaaatgcctgcttcttctgtactgcctaaaaatattcatgcttgagctatcttgaaagcttcctctggttgcaatattatagtttttgtcaggtacattgctgcctctgtgtctttgcttaaattaagcctgctttctttc

SEQ ID NO: 121 - DNA, 1070 bp, Populus tremula x Populus alba
gagatttatagtaataaatttcggcatcaagaattgagtgtcgctctcatttctcacagacagagagagagagagggacagaatggacggtgacgatgtggacatggccgctgtggagaccgctgaagcagtaccagaacttgatgatatgaagaagagattaaaggagatggaagatgaagctgctgctcttcgtgagatgcaggctaaggttgagaaggaaatgggttctgttcaagatcctagtgcttctgctactgcatctcaagcaaataaagaggaagtagattctcgatcagtgtttgttggtaatgtggattatgcgtgcacccctgaagaagtgcagcagcattttcaggcatgtgggacagtaaatagggtcactatccgttctgacaagtatggccaaccaaagggttatgcatatgtcgaatttgttgagccagaggctgtgcaggaggctctccttttaaatgaatctgaattacatggccgccaattgaaggtaactgctaagcggaccaatgtacctgggatgaagcagtttcgcgctcgtcgacccaacccgtacatggggtttccacccaggggtgcaattatgcctccttatctcttctctccttatggatacgggaaggtaatgagatatagaatgccaatgcgttacagcccctatggctaaagtatgatcttgcttgagacagcattgccagcagatagatacatccgacaaaatttgtgctcttttcttctcacatattttaatgtttgggtgggatgaacagaagacgtttccctgcatgggttgaaatggtgtaatgtgaaaatggagctttgttttgatcatggtagacaattaaattattcttgcttgcgttttgggtgtactgcctataaatattctatcttgaaagcttcctctggttgcaatattgtaggttttgttaggtccgttcgctgcttctgtcttttcttaaaatgaagcctccttttttctgggagatctttctgtttgagatctcaactgatggcgctatgattttgtttactgttttttgcaccgcagttta

SEQ ID NO: 122 - DNA, 843 bp, Solanum lycopersicum
ttttttcttcctcctccttctctaatcaccagccaatgcattaacccatatttcaatggcaggttctgaatttcctcacgcatatccacaaacgccaagtatcgatacttccgaaacgctatttcaacgacgtagccgttgtttctgcttcccatctttccgttctccgaatcaattaacaaaatacgttaagtttgactggtggcataggttacgtagcggtgcggttaaggagggatctgtatgggctaaaggaatcaacgctttgaagaagcttcgtgaatggtcggagatcgtcgccggacctagatggaagactttcatccgtcggttccatcggaacaaaagcggtaataggaatgcgaaattccaatacgatcctttgagttactcactgaacttcgatgaaggacgagggaataacggagaagaggaggaggaattggtacttcggaatttctcgacgagatacgcatcgattccggcgtctagtaacttgggcaaagatgggcccagtttcgtttgagttgcaaacgcaagtactatactatttgacagtgattggactggaccgatcgataaatttatattatcgtcaatcataaattagtctcagcgtataatttcgagacaattcaatcccccttacagttcagtagtggggcaaagaaaacaacagctcatcataaaagataagttttctaccaacaaaaaaaatattattgtggttggtcttatttgtctaatgtctttttcgttgtttaatttaatttacttctcttgtctctacttgtttttgtctttatgcactgtaaatacaatatccattttttttgtgtgata

SEQ ID NO: 123 - DNA, 822 bp, Ricinus communis
atcgtcttacagttgtcaatagaatgggcgtcgaagaccctgaagctgtctctgtttccgtgggcgaccaatcgtctaattctctcctgatgaacagccgctgctgcttctgtttcccctgcttaggttctcgcggatcgtccaccgtcggtttagcctggtgggagcgaatacgatcgtctaaagggcatcctagtgaggaggataataagccaaagtggtggagtaaaggagtcagggctttaaagaagatccgagagtggtctgagatcgttgctggtcctaagtggaaaactttcatcagaagatttaatagatgcaacagagggagtggtaacggccgtcataacggcaaattccagtatgatcctttgagttacgctttgaattttgatgaaggacagaacggtcactttcacgatgaggagaacgatgattacggcgggtttcgtgatttctcatctaggtacgcttctgtttcggcctccggtaagccgctttctatggatgtttcatctcgtgataaggagatggcagtaaatgcgtgaaggaataattaatttctttctttttggtgtggttgaaaaaaatgtggaaaggaaaaggaaaaggaaaagttgcgccgtggaaagctggtatccgccggtatgcgttcgacaatagctggagtgttgacttgattacgtaacatgacggcgctgtttcttgttttatttaataatagtaataatatatacatattcagtagattattaaaatttaataataaagagttttgtttggttaagaagcgtgtaaagagctaaagagatgatgatgatg

SEQ ID NO: 124 - DNA, 924 bp, Populus tremula x Populus alba
agagagagagagagagaagagagagaactggatcaatccaaatggcctttaaaggggcagaaccgatcccagaagaaacgacgtcgaattctctcttaacaaacacgcgctgctgcttctgttttccctgtttttcttcccgacgatcctccaccgtcggattatccttctgggaacgaatccaatcatcatcacagtcacacggctatgatccccatcaaaatcaatggtggttcaaggggataagagcgttgaagaagatcagagagtggtcagagatcgttgcgggtcctaaatggaaaactttcattcgaagattcaatcgaagtaaaagcagtggcagtggtaacggaaggcgccatgggaacttccagtatgatcctttaagttactcgctgaatttcgatgaagggccgggaggacagaagggggatttcgatgaattggatgattacggtgggtttcgcgatttctcctcccgttacgcctccgtgtcggcctctggtcagccggtggctatggatgcctcggagagtaaagacgttgtggttatggcttgagagagaggaggagctgtgagcatagtgagggcacaattgatgctaatttgcgccgggctgtgcaggataacgatcgagtgtttgttgacttagtgacgcaatgtgccggcgcgttcctctatagtatcattatagcttatagctgtatagatagagttttattacctttgtttttttggttaattaaataaatttgagacggtaggggtggcaatgacaaggaaacacgtgtcaggaaaatggccagtttgctttttatgcatgtatttttttatatatataaattgggtagggctttgtcttgtaacatttgtgtgtattcataaatacatagtttaaatcaaaacaaagatattttaggaga

SEQ ID NO: 125 - DNA, 1138 bp, Populus tremula x Populus alba
gatcaatcgaaatggcctttagagaggtagaaccgatcccagaagaaacgacgtcgaattctctcctaacaaacacacgctgcggcttcctttttccctgcttttcttcccgacgatcctccagcgtcggattatccttctgggagcgaatcaaatcatcaccttcatcaaacggcgatgaccctcatcctaatcaatggtggtccaaggggatgagagcgtttaagaagataagagagtggtcagaagttgttgcgggtccgaagtggaaaactttcattcggagattcaatagaaataaaaacagcggcagcggtaacggaaggcaccatgggaaattccagtacgatccctttagttattcgctgaatttcgatgaaggaccaggaggacagaatggaaatctcgatgacttggatgattataatggttttcgcgatttctcctcccgttacgcctccgtttctgcttctggtcggccggttgctgtggatgcgtcgaagagtaaagatgtggcggttatggtttgagaggagaggagaggagaagagaagggaagggaagtgaagcgcgcgcgcgccgtggatgctagcattcgctgaggagggtcacagatggagtggagtgtgtgttgactccgtgacgtaggcgcggtcatgaaacgcggccgttcaaatggtattttataaaaatttaattttttattgaaaattaatttttatatgccaatattaaaaatattttttttaaataaaaaatatattattttaatatatttttttaaaaaacaatttacatattctcaaacacctaaaatagcagcgtgaactctcctactagctgtacccacaatattgtggtggaggattttctcaaaagatttttaaaaaaaattaaaaaagttttatttcctaaactttttggttaatttattgaaataggatatagcaagacgacggtgataagacaaggacatgcatgcgtgttaggattaaagagagggtttggttggcttctttgctttataaatgtatttttttttttttataaaatgggtttcttcttccgacaatattctggtattgcctctcttgcttgctgtgtacgtaacaaaaaaaaaaaatatttatggtgatgt

SEQ ID NO: 126 - DNA, 750 bp, Brassica napus
gataagaccccgttttgtaaaagtcgcgattttgtttggatttttggaaaatattctgggaacaaaaaggaaggagcggcggatgagtcgctgattcgatgggaaaccagaagcttaagtggacggaggaggaagaggaggcgttgctcgcaggtgttaggaagcatggtcccggaaagtggaagaatattctccgagatcctgagyttgctggtcagctctctaatcgctccaatattgacttaaaggataaatggcgtaatttaagtgttgcccctgatattcaagggtcaaaggataaggtgcggacaccaaagatcaaagctgctgcctttcagctggcggcagttgcagctgccagtactccatctcctagttccaaccattctccagttccgccccttcctcgtagtggatctgatttgagcattgatgacagttgcaactttatggttgatgcaaagaatgctcccaggtatgatgggatgatattcgaagctctttcatcgttgacggatgctaatggatctgatgtcactgcaatttacaactttatcgtgcaaaaaggacatgaagtgccaccgaactttaaaaggatcctcggttcaagattgaggaggcttgcttctcagggcaaacttgaaaaggttagccagttaaaatcaggaacgcagaacttctacaagatgaataatcatagcttcatggcgatgagaacgccacttgtagcgagaccaaaagaggtgaatg

SEQ ID NO: 127 - DNA, 604 bp, Brassica oleracea
aggataaggtacggacaccaaaaatcaaagctgccgctttccagctggctgccgttgcagctgccgctaccactccatctcctagttctgtctcttctccagttgctcctccccttcctcgtagtggatcttctgatttgagcatcggtgatagttgtaacatgttgattgatgcaaagaatgctcccaggtatgatgggatgatattcgaagctctttcagcattgaaggatgctaatggatctgatgtcactacaattttcaacttcatcgagcaaaaaatgtatgaagtgccagaaaaaagggtcctgggttcaaggttgaggaggcttgctgctcagggcaaacttgaaaagacgcagaacttgtataggatgaataataatagcttcttgacaatgagaacgccagttccagcagcgagaccaaaagaggcgaatgcgaaaccccggaacagccaaggactcacggtttcgcaggagaagattgctcttgcttcaggaaccgcagcttttaagctctacgagttagacggcaaattagaagtgttgggtggagctgtagatgatagagcaaggatgacagaacttgcagaacgagctga

SEQ ID NO: 128 - DNA, 1291 bp, Solanum lycopersicum
gagcattagcgaatagcgatagagagatatgggaaatccgaaggtaaagtggacgtcggaagaggaggatgccctaaaagccggtgtgacaaagcacggtagcggaaggtggaagaatatcatcagagatcctgaattcgccccgattttgattaatcggtctaacatcgacctcaaggacaaatggagaaatatgtgtatttacactgctggacaaggttcaaaagataaatctatagttgttcgtacaagaccaatggaaatagatgcatttgtgccttcccctattcaaagtcttccgcctattacttcagcatttgagaatgaagccatcgaggattctcccgacgtccaaccagaaggcgtgaatgctccaaagtataatgatatgatctttgaagctttgtcatccatgggggattcaaatggatctgatcttggtgccattgtaggatttattgagcaacgacatgaagtacaaccaaactttagaagaaccttgagttccaagttgagaagactggttgcgcaaggaaaacttgaaaaggtccagaagtgctataagatgaaagatgcaacatcagaaaccaatatatctactccacaacaaaatgatgtccggtcatggccagttccgaattcggttccaagacaaagtgatgtcctgtcttggccagttccgagttcagctccaaaacaaaatgatgtcctgtcatggccagttctgaattctgctccaaagcaaaatgatgtccggtcacgaccagttccaaatatggcttcaaaacaaaatgatgtccggtcatggcaagttccaacttcgggtgtaaaagtctccagtggaacagcagaagaagctgctaggattgctgctgacattgttgctgatgcagaaaataagcgttgcttggaagttgcagcagtcagagatgcagaaatgaagctaagaatggttgacgatgcagagtcaatgttacaaattatcaaagagatytatgaacattgtttacaaggtgaaattatttttttggcttgatccccatgtgcgatggcttgtatatactgctcgttgagatgccgagatgcttttcattttttgatagcagttggttccaaactttagggtgccaacctatttactttcctttagaagtatacttgagaaaaataatggagcttcagagactatgatagttgattttttgtgtatccttcccagtttaagctctttagcagaaaatacagaataggttatgtttcaaaaatcaaaatccagttaatagataggtta

SEQ ID NO: 129 - DNA, 1050 bp, Ricinus communis
atgccctcctctcctcctacctgcctctgccaaatgcaatgtaaatgctgccatttttctggactccaaccgtattgggtttggctgcgtcagtcacagaagagagaaaaagcgggagcgagaaaagaaaaaaaagaagaagagaacaccggcctctgcaaaacaaaaacaagagcacagagacgttacgagttcgaagaagaaagcttcgacgaagaaggagaaggggctaaaatgggaaaccagaagcaaaaatggacggcggaggaagaagaagcgctgttaaacggagtagcaaaacacggccctggcaaatggaaaaacattcttaaagatcctgattttgctccttttcttactcaacgttctaatattgacctcaaggacaaatggcggaacttgagcgttagtaatgctgcacaaggttctaatcctaaaacaagaggggcccctaaacctaaaatcttaccacttcctccaccctctaacgccaatgctcaaattactgctactgctgatgctcttatggatgactgtttaaacaatgcagcagatggaaaaaatgccccaaggtacaacgcaatgatttttgaagctctttcaaccctaaaagatataaatggatgtgatattagtgctattgttcacttcattgagcaaaggcatgaagtgccacaaaattttagaaggttattaggttcaaggttgagaaggcttgtgtcacaaggaaaactggaaaaggtccaaaatggctatagaatcagcaaagatgctgcactgggagctaagacaccaacgccaagacaaaaggatgtcaggccgcgacagtcacagaattctggattaacttctggcgagactgtggaagaggcagctattgctgctgcttataaagttgctgaagcagaaaataaatcatttttagcagctgaagcagttaaggaggcagaaagagtatcaaagatggcagaagataccgactcaatgctccagttagtgaaagatatatatgagcaatgctcacgaggtgaaattgttctcctggcttga

SEQ ID NO: 130 - protein, 501 aa, Gossypium hirsutum
GITVCSPRKHEPPRCLNYLTSPHVVIWSAVSASCAFPGLFEAQELMAKDRSGELVPYHPPFNLDPEEGSSATARRWRDGSLEVDLPMMQLKELFNVNHFIVSQANPHIIPFLRVKEFVRAHGGNFAAKFAHLTEMEVKHRCSQILELGFRMGGLAKIFAQDWEGDITVVMPATVSQYLKILQNPTLVELQKAANQGRRCTWEKLSAMKANCGIELALDECVAILNHMRRLKRSADRAAAASSHGLANTTKFSASKRIPSWNCIARENSSGSLEEDLLTDVTSSLHHGVGSSSGIPPPARNLRAHRSAYDGSDSESEGVDLHSWTRSGGPLMRTSSANLFIDFVQNLDAEAEVNKGLMAHPSSPGFQICGGDSFSHSPRMMKSDRGSEYEFDQRDFGNRPPVNGSSIMVTEGDLLQPEKVINGLMLNVVKKADLAQSSRSPDSDNCSTEVAECVQLECPEKDDSSASECGDDDAGAVNETVATDNLTRSARDDDNQGGVVDA

SEQ ID NO: 131 - protein, 439 aa, Gossypium hirsutum
  misc_feature (202)..(202): Xaa can be any naturally occurring amino acid
  misc_feature (275)..(275): Xaa can be any naturally occurring amino acid
EEIVFSFLGGGVPKMTNQENSVIVVMVPFPAQGHLNQLLHLSRIILSYGIPVHYVGTSTHNRQAKVRVHGWDPVAVASFHFHDCQVPPFASPPPNPNAAIKFPSHLQPCFDACHHLRKPVTELLRMLSLQAKKVVIIHDSMMGSVVQDVGSIPSTESYAFHTVSAFSLFFYLWESAGKPQVNAEMLGENDVPSLEGCFTEDXLEFIALQHRYLNVTSGSIYNTSEVIEGTYVELLRQHMKEKHHWALGPFNPLKVPEKNSCGSRHYCLEWLDKQXMNSVLYVSFGTTTTMGDEQIQELAIGLRRSNQKFIWVLRDADTGDVFNGEVRRPELPMGYQDSVKDKGLVVRDWAPQLEILAHPAIGGFVSHCGWNSCMESITMGVPIGAWPVHSDQPRNAVLITKLLKLGITIKDWARRDEVVTAAVVEDAVKRLMASEEGDE

SEQ ID NO: 132 - protein, 280 aa, Gossypium hirsutum
FSTKGHKSQNHRKFHQNPANYAPCPSPTIFIHSPCFKVKSHFTHLRQEIQIPIFTTIKPHPTDMGAHEEEAGGEEYLFKIVLIGDSAVGKSNLLSRFARNEFDNNSKATIGVEFQTQCVEIDGKEVKAQIWDTAGQERFRAVTSAYYRGAVGALIVYDITRRSSFDSIKRWLDELTTHCDTTLTRMLVGNKCDLENIRDVSVEEGKSLAEEEGLFFLETSALESTNVQTAFEIVIREIYNNVSRKALNSDSYKGELSGNKVTLVKDGANASKTGFSCCAR

SEQ ID NO: 133 - protein, 365 aa, Gossypium hirsutum
MAQNMARRRVVLVQILALALAAVMPLLSGGVDIQQVRVLAAKFNVTCVVVFGDSSVDPGNNNYIATPFKGNFLPYGKDFFRGHPTGRFSNGRLATDFIAEALGYTNEIRPFLNKRLRPVDILHGVSFASAASGYDELTANLSHVLPVSKQLEYFREYKMRLRQLVGARKAENIIKNAVAVMSMGTNDFLQNYYLEPIRPKQYTLEEYQNYLASCMSDDVKTMHSLGITRLVVVGVPPLGCMPLVKTLMNQETCVEKYNNFSSSFNSKLQFKLEVARTTLGMKIGYVDAYGIFEDAVNNSKKYGFIEASKGCCGTGTIEYGDTCRGMSTCADASKYVFWDAVHPTERMYEIIAGQAIDSLRKQLMA

SEQ ID NO: 134 - protein, 467 aa, Gossypium hirsutum
MELFSFLLIISIFYLLFKIWNWINNVRDQQCYILDYQCYKPSDDRMVGTEFCGEVIKRNKNLGLNEYKFLLKAIVSSGIGEQTYAPRIMFSGREESPKLEDGILEMEEFFHDSIEKVLSRAGISPQEIDLLFVNVSMLSTVPSLCSRIINHYKMRPDIKSFNLTGMGCSASLISLDIVRNVFKSYKNKFALLVTSESLSPNWYAGNDRSMILSNCLFRSGGCAVLLTNNKSLKHRAMFKLKCLVRTHHGAKDESYGCCIQREDDKGRMGFHLSKSLPKAATRSFVDNLRVITPKILPVRELFRFMAVSLLKKWNVVRHGSSHKGASQGPIKAGVNFKSGVDHFCIHTGGKAVIDGIGISLDLTEYDLEPARMTLHRFGNTSASSLWYVLAYMEAKKRLKKGDKVLMISFGAGFKCNSCLWEVVRDLGDGNVWKDEIYMYPPKTLVNPYMEKFGWIQDEDPSTFNPGD

SEQ ID NO: 135 - protein, 417 aa, Gossypium hirsutum
  misc_feature (110)..(110): Xaa can be any naturally occurring amino acid
KKTMEDLAVDKIVNIGIGLVPPEMADQLYEGIHSHLENVGIDGVKVDVIHLLEMLCENYGGRVDLAKAYYKALTDSVKKHFKGNGVIASMEHCNDFMFLGTEAICLGRVXDDFWCTDPSGDPNGTFWLQGCHMVHCAYNSLWMGNFIHPDWDMFQSSHPCAEFHAASRAISGGPIYISDTVGNHNFALLKRLVLPDGSILRCQYYALPTRDCLFEDPLHDGKTMLKIWNLNKYTGVIGAFNCQGGGWCRETRRNQCFSEFSHTVKAEMNPKNIEWNSGKNPISIEDVQVFAMYFSQSKKLVLSKPAENMEISLKPFDFELITVSPVTVFGRKSVQFAPIGLVNMLNAGGAIQSLAYNESSVRIELKGAGEMRAFASNKPTACKIDGKDVGFEFENNMVIVHVPWPAPSGLSTLEYLF

SEQ ID NO: 136 - protein, 256 aa, Gossypium hirsutum
MARKIVLILVLRCLCIGLAAADWNILNPIWNINARQDSLKNYCESWRINVELNNIREFDVVPQECVAHIKKYMTSSQYDADCQRAIEEVTLYLSRCCSLKGDGKDAWIFDVDDTLISTIPYFKKHGFGGEKVNSSSLEAWMEESKAPALDHTFKLFHDIKDRGMKIFLVSSRKETLRSPTVDNLINVGYHGWSRLFLRGFEDEYMHVEQYKSQVRKTLMDQGYRIWGIVGDQWSSLKGLPEAKRTFKLPNSIYYMS

SEQ ID NO: 137 - protein, 189 aa, Gossypium hirsutum
MVTIPFFVLIILLFLSSSAATPKSGAGHDLVRSSCVHASYPSLCFRTLSSYSGPANTPRELAQAAVKVSLSRARKVSNYLSTSVTGYNKRERVALSDCVEQIDESMEELSKTLGELKHLRGETFEFQMSNAQTWVSAALTNEDTCLDGFEGVDGKVKSDVKRKITNVAKVTSNALYMINRLNESRGRHR

SEQ ID NO: 138 - protein, 384 aa, Gossypium hirsutum
  misc_feature (67)..(67): Xaa can be any naturally occurring amino acid
  misc_feature (88)..(88): Xaa can be any naturally occurring amino acid
  misc_feature (92)..(92): Xaa can be any naturally occurring amino acid
  misc_feature (135)..(135): Xaa can be any naturally occurring amino acid
  misc_feature (153)..(153): Xaa can be any naturally occurring amino acid
  misc_feature (167)..(167): Xaa can be any naturally occurring amino acid
  misc_feature (267)..(267): Xaa can be any naturally occurring amino acid
  misc_feature (298)..(299): Xaa can be any naturally occurring amino acid
MIFSIFKSQVFIRNGSVILPTCAKNVSFSRPIALLLVRYESGIAENEQPFKISYLINTIGLSPQSAXSVSKKLHFETSQQPDTVISFXNNHXFSRTQIRDIVQKWPASLLCNPEKTLLPKLQFFYSKRISGSQLXRILSSNPDAFRRSLDNCXIPNFNSFKEFTRCXDDQVFLAYKNYSDVLSRNFQSIVAPNIAILKEYGVPESNIMVELVVHPRAYAVSPDKFSRTVEQVKKMGFNPSKRRFLTALQAFLQTSKSTWEKKFDLLXQWGWSNEVVLSAFEKYPRFMMFSEKKITTIXXFFVHTMGWKSLDIANRPVILSYSLERRIIPRCSVLQALLSKGLIKKFSVCLVLEYTEKAFLQRFITPYEDPYILKLYEQKLGLSE

SEQ ID NO: 139 - protein, 217 aa, Gossypium hirsutum
  misc_feature (2)..(3): Xaa can be any naturally occurring amino acid
MXXYRVDDDYDYLFKVVLVGDSGVGKSNLLSRFTRNEFSLQSKSTIGVEFATRSIRVNDKIVKAQIWDTAGQERYRAITSAYYRGAVGALLVYDVTRRVTFENVQRWLKELRDHTDSSIVIMLIGNKADLRHLFAVTTDDAKAYAESENTFFMETSALESTNVEHAFTEVLTKIHHVISRKALEGGNDQTTLPKGQTINVGSRDDVSAVKKDGCCSA

SEQ ID NO: 140 - protein, 195 aa, Gossypium hirsutum
MEGDDVDMAAAESTEADLDDMKKRLKEMEEEAAALREMQAKVEKEMGSVQDPAAAAATSQANREEVDSRSVFVGNVDYSCTPEEVQQHFQTCGTVNRVTIRTDKYGQPKGYAYVEFVEAEAVQEALLLNESELHGRQLKVTAKRTNIPGMKQYRPRRSNPFMRPRGPFMAPYFFAPYGYGKVPRLRMATRYSPYY

SEQ ID NO: 141 - protein, 176 aa, Gossypium hirsutum
GHNISEDTWQQVLAFSWCVHETLEGYDPEGAWPVLIDDFVEHMYRISGSNKDTNGFCSYGDSGSQLCAYDDSLPGLKLVPGLKRKLRECNNDKMESLEPLFSSSPNPNCTSNSKRRFILCRSDEREDNLPQNSCDESMEIVKQSSPVGSSKSPCAVEGCMSKGLAGLLSCCSYFAV

SEQ ID NO: 142 - protein, 217 aa, Gossypium hirsutum
  misc_feature (21)..(21): Xaa can be any naturally occurring amino acid
NPQSTISSSQVFFIHVCCGLXLVAGFWVAHHVYSLNLVFDPTKTLCLIWAIEFPVVILLFSCCRQKPEKCSYFTAIARGLLGLPIGALLNALGALALGAPVGLQYLKKTVNWSLLMSSFTFVPTACVYGSSWTDWCRIFACTKPNGPLEFMLCLPAHGAVIGAWFGAWPMPLDWERPWQDWPICVSYGAMAGYVVGMVGSFGLALIMHTGRKQLKAK

SEQ ID NO: 143 - protein, 172 aa, Gossypium hirsutum
HRDKKRGISITVMAAAAHIDIEPAIPEEETTSNSLIRNTRCCFCFPCFSSRRTPAVGVAFWQRIGSSHVQSDTGFWSSSVRAFKKVREWSEIVAGPRWKTFIRRFNRSKSGGGIVSGGRHGQFHYDPLSYALNFDEGPRQNGNLEDDNDFGAFRAFSTRYASVPGSEKTPLA

SEQ ID NO: 144 - protein, 276 aa, Gossypium hirsutum
  misc_feature (9)..(9): Xaa can be any naturally occurring amino acid
  misc_feature (58)..(58): Xaa can be any naturally occurring amino acid
  misc_feature (93)..(93): Xaa can be any naturally occurring amino acid
  misc_feature (111)..(111): Xaa can be any naturally occurring amino acid
MGNQKQKWXAEEEEALLAGITKHGPGKWKNILKDPEFAPFLTHRSNIDLKDKWRNLSXSTSTQGARDKSRAPKVKAIVASLPNTPNSSAPVAXRAHNVTSDTVVGDSSNNXIDGKNAPRYNTMIFEALSTIKDTNGCDISAIVSYIEQRHEVPPNFRRLLSSRLRRLVSQGKLEKVQNCYKIREDTLMGTETPTPKQKDVRLRQNSDAIGSGETVEEAAITTAYKVAEAENKSFLAAEAVKEAERVSKMAEDTDSMLQLVKEIYEQCSRGETVILV

SEQ ID NO: 145 - protein, 97 aa, Gossypium hirsutum
ASPPLSLNIKKIISVCVCVFFFFLWSGLKMVCFCFLVDQRHMLMSSKPAAGTCLRCRSGASVGLMKTVTRFCYVPIYWKSWKAIICTFCGAVLKSYR

SEQ ID NO: 146 - protein, 177 aa, Gossypium hirsutum
MGLAAALLFLLLAAPAAFAEQYTVGDSSGWTTTGDYQSWVQGKTFTVGDTLLFTYGGSHSVEEVSKSDYDNCNTGNAIKSYSDGNTVITLSNPGAMYFICPTIGHCAGGMKLAINVVAASGNSPSTPSTPSGSTTPSGTPPSGGTTTSPPSTPSGAPSTVNYGFMVALLGAVVGIMC

SEQ ID NO: 147 - protein, 525 aa, Gossypium hirsutum
MPKPFHLLVFFLVALCLCTNSNASSSTNEFLETECLKVPATEFIGSLKTTIDAIRKATSVVSQFGGFFHDFRLSNAIFDCLDLLDSSADELSWTMSASQNPNAKDNSTGDLSSDLRTWLSAAMVNQQTCIDGFEGTNSMVKTVVSGSLNQITSLVRNLLIMVHPGPNSKSNGTRNGSQKGGGGGGHPGQSRFPVWFKREDRRLLQINGVTANVVVAADGSGNFTRIMDAVETAPDKSMNRYVIYIKKGLYKENVEIKKKKWNLVMIGDGMDVTVISGNRSFIDGWTTFRSATFAVSGRGFIARDITFENTAGPQKHQAVALRSDSDLSVFFRCAIKGYQDSLYTHTMRQFYRECKITGTVDFIFGDGAVLFQNCQILAKQGLPNQKNTITAQGRKDPNQPTGFSIQFCNISADTDLLPSVNSTPTYLGRPWKLYSRTIIMQSYISDAIRPQGWLEWNQDFALDTLYYAEYMNNGPGASLSERVKWPGYHVLNNSAQAVNFTVAQFIEGDLWLPSTGVKYTSGFGV

SEQ ID NO: 148 - protein, 139 aa, Gossypium hirsutum
MANAASGMAVHDDCKLKFLELKAKRTYRFIVFKIEEKQKQVVVEKLGEPSQSYDDFTASLPADECRYAVYDFDFVTAENCQKSRIFFIAWSPDTSRVRSKMIYASSKDRFKRELDGIQVELQATDPTEMGLDVIRSRAN

SEQ ID NO: 149 - protein, 199 aa, Gossypium hirsutum
MATPPLSSPTYLTTNLGVGYAIVVALGFLLLLSTLLLASYICFRSSSPLPPRAISPNPISTPTAANSDGIVLPRIVFIGEEDHENDEENVVVFGLDRAVINSYPKFRFSKKEVSTAVEVTGSSAGNTICSICLCEYRESEMLRMMPECRHCFHVTCIDAWLKLNGSCPVCRNSPLPTPISTPLSEVIPLSQYDADRRWW

SEQ ID NO: 150 - protein, 466 aa, Gossypium hirsutum
SPMEEAIVIYPASMLTHLAPMVEFAKLLLTQHPSLSIHILIATLPSQPSSTVPSPVPPSITFHYLPTFDLLPTSTDLDPLFFDVIRLRNPDVRRTLLTISNNYTLNAIIVDFFCTSAAFEVASDLNLPAYSFLPTALGAAACLLYLPTLCNKFTQSFQHLNVLLDIPGAPPIPSADMPPTTFKGNKLYDVFLDIATNLPRSTGIIVDTFEYLEPKSFKEINDGLCLPDYPTPPLYCIGPLIVNTTVDGDGVPQCIKWLDSQPSKSVVFLCFGSLGSFSVQQLKEIAVGLERSGQRFLWIVRNPPLENQSLNIDTKVDPDLKSLLPPGFLERTKEKGLVVKSWAPQLAVLNHDSVGGFVTHCGWNSVLESVCAGVPMLAWPLYAEQRFNRVLMVEEMKIALPMVESETGFVSSTEVEKRVKELMGSKEGDSVRERALAMKHAAKVATSEGGSTRIALAKLVESWKQK

SEQ ID NO: 151 - protein, 778 aa, Gossypium hirsutum
MAENPVKWLFLILASCLCFAFVLSESNSLIKKTYIVQMHKSAMPASFSSPLEWYSSKLKSVMSDTQSEGEGDGENRIIYSYQNAFHGVAAQLTEEEAERLKQEDGVVAILPETKYELHTTRSPMFLGLEPEESTSIWSQKLADHDVIVGVLDTGIWPESASFNDTGMTPVPPHWKGTCETGRGFKKHHCNRKIVGARVFYRGYEAATGKINEKNEYKSPRDQDGHGTHTAATVAGSPVRGANLLGYAYGTARGMAPGARIAAYKVCWTGGCFSSDILSAVDRAVGDGVNVLSISLGGGASSYSHDSLAIATFGAMEMGVFVSCSAGNGGPDPVSLTNVSPWITTVGASTMDRDFPGSVKLGSGRTISGVSLYKGRRLLQANKQYPLVYMGSNSSSPNPSSLCLEGTLDPHVVSGKIVICDRGINPRVQKGQVVKDAGGVGMILTNTAANGEELVADCHLLPAVAVGEMEGKAIKHYALTNGKPTATLAFLGTRLGVRPSPVVAAFSSRGPNFLTLEILKPDVVAPGVNILAAWTGELGPSSLPTDHRRVRFNILSGTSMSCPHVSGIAALIKARHPDWSAAAVKSALMTTAYVHDNIHNPLQDSSTAAASTPYDHGAGHINPLKALDPGLIYDISAQDYFVFLCTQKLTAMQLKAFSKHSNMSCHHNTLATPGDLNYPAISVVFPEDTAISTLTLHRTVTNVGPPASHYHVVVSPFKGVTIKVEPKTLNFTRRNQKLSYKISFTRKSPQTMPEFGGLVWKDGVHKVRSPIAITWLPPF

SEQ ID NO: 152 - protein, 204 aa, Gossypium hirsutum
MSIFEYNGSALIAMVGKNCFAIASDRRLGVQLQTIATDFQRIYKVHDRLFLGLSGLATDAQTLYQRLVFRHKLYQLREERDMKPETFANLVSAILYEKRFGPYFCQPVIAGLGDEDKPFICTMDSIGAKELAKDFVVAGTASESLYGACESMFKEGMEPEELFETVSQALLSSVDRDCLSGWGGHVYVVTPTEVKERILKGRMD

SEQ ID NO: 153 - protein, 568 aa, Gossypium hirsutum
PSHQSHKKHPRRNPWNSTSLLVSLSMSAFLLLSLLSLSHFFIFSSSSHHPPHNSPVYASDSSRIRLACKSTRFPQPCESSLSRSSLLPPNPTSLQFIQSAISVSSDNLKTGQSMVKSILDSSKGNLNRSNAAAICLNILSNSDYRIRSTNDALARGKIKDARAWMSAALCYQYDCWSALKYVNDTKLVGETMAFLDSLTQHSSNALSMMVAYDNIGEDIAAWVPPKTERDGFYENGSGGTELGFNGGLPSNLKTDVTVCKDGSGGCYKTVQEAVNAAPANAESTRRFVIYIKEGVYEETVRVPLEKKNVVFLGDGMGKTIIAGALNAGMPGLTTYETATVGVLGDGFMASGLTIRNTAGPDAHQAVAFRSDSDLSVIENCEFLGNQDTLYAHSLRQFYRKCRIQGNVDFIFGNSASVFQDCEILVAPRQVKPEKGENNAVTAHGRTDPAQSTGLVFQNCLINGTDEYMRYYYSKPKVHKNFLGRPWKEYSRTVFINCVMEALINPNGWMPWKGDFALKTLFYGEFGNSGLGSIPLNRVPWSTQIPPQHVHTFSVQNFIQGDQWIPTSS

SEQ ID NO: 154 - protein, 574 aa, Gossypium hirsutum
MDCKSWGSRDIVFLCIIVLSLIHVSLGAKVRHFKWEVEYMYGAPDCQEHVVMGINGQFPGPTIRAKAGDTIVVDLTNKLHTEGVVIHWHGIRQLGTPWADGTASISQCAINPGETFEYRFKVDRPGTYFYHGHYGMQRSAGLYGSLIVDMADGEKEPFHYDAEFNLLLSDWWHKSVHEQEVGLSSNPFRWIGEPQSLLINGRGQYNCSLAAKFSNSSISQCKFEGNEKCAPQVLKVRPNKTYRLRIASTTALASLNLAIEGHKMVVVEADGNHVQPFAVNDLDIYSGESYSVLLKTDQNPYKNYWVSIGVRGRDPKTNQALTLLSYSATPASKLPTTQPPVTPRWDDYNHSKAFTKSIYALMGSPQPPKTYDRRIILLNTQNRLNGFVKWAINNVSLVLPSTPYLGSIKFGLNNAFDQKTPPDNYDSSYDIMKPAPNQNTTQGSGVYTITLNTTVDVILQNANALAKDVSEIHPWHLHGHDFWVLGYGEGKFKNGDEKTFNLKNPPLRNTAVIFPFGWTALRFVADNPGVWAFHCHIEPHLHMGMGVIFAQGAHRVGQIPKEALACGLTGNKQN

SEQ ID NO: 155 - protein, 545 aa, Gossypium hirsutum
TLDLSGNNLTGTIPTELTTLPKLVRLDVSNNRLYGKVPPFRQNVAVITAGNPDIGKEMASPPAGKSPGGSPAGGGGSSGSSSGNGEKKSNTGTVVGSAIGAVGGLSLLVLGILLYARKGKRTSKVQSPTTVVIHPHHSDDQDGVKITVAGSSVTGGSETFSHTSSGPSDVHLVEAGNMVISIQVLRDVTNNFSEENVLGRGGFGTVYKGELHDGTKIAVKRMESSVVSEKGLAEFKSEIAVLTKVRHRHLVALLGYCLDGNERLLVYEYMPQGTLSRHLFNWKHEGLKPLEWTRRLTIALDVARGVEYLHGLAQQSFIHRDLKPSNILLGDDMRAKVADFGLVRLAPVDGKQSIETRLAGTFGYLAPEYAVTGRVTTKVDVFSFGVILMELISGRRALDETQPEESMHLVSWFRRMHMNKETFRKAIDETIQLDEETLASVSTVTELAGHCCAREPYQRPDMSHAVNVLSSLAELWKPAEPDSDDIYGIDLELTLPQALKKWQAFEGNSNVDDSSSFLGSTDTTQTSIPCRPPGFADSFASADAR

SEQ ID NO: 156 - protein, 332 aa, Gossypium hirsutum
HDAFVVKKKMVGVFRLVRGYPGPSGFGSASTAQEVTEGIDGTNLTALVTGGASGIGLETSRVLALRGVHVIIGARNMKAANEAKNKIVRENTRARIDVLELDLCSTSSIRSFADNFIALHLPLNILINNAGIMFCPFQLSQDGIEVQFATNHIGHFLLTNLLLDTMKNTVKATGIQGRIVNLSSIAHHYCYNKGIRFHKINHKQGYSEKRAYGQSKLANILHANELSRRLQEEGVNITVNSVHPGLIMTPLFRHSAALMKLLKFFSFFLWKNVPQGAATTCYVALHPRLNGVTGKYFADCNEMRPSSYARNESLGRELWEFSNKLISSVSEP

SEQ ID NO: 157 - protein, 90 aa, Gossypium hirsutum
MKLLFLTLLLCSLLLCSSVFAPTMAQPRSPFCEGKCKGRCNKAAVWDRCFKYCGICCEECQCVPSGTYGNKHECPCYRDKVNNKGKPKCP

SEQ ID NO: 158 - protein, 263 aa, Gossypium hirsutum
  misc_feature (204)..(204): Xaa can be any naturally occurring amino acid
MWSFASNTIASIGLKSSKEANQACSECSDDELCSNGSRDEGLECPICWEPFNIVENVPYVLWCGHTLCQNCILGLQPAVLKLPTQQIKIPMFISCPWCHLIALRLVYKGNLKFPRKNFFILWMIESLNGDRYGISRRNLSGDNQAVGSLRCNLMLGNQAISGVVRRGSYANRSEQNRSLDTGGRNNAERHHFSLHKSLDFFIHXTSKFPLVTIFLLVVFFAIPGSAVILLLHFLVTVVFAIPSFLVLYFALPMLDRLVREITS

SEQ ID NO: 159 - protein, 169 aa, Gossypium hirsutum
DTPEELLSNEGSSFSKMVQSTGDANAQYLRSLALGGGEDSVGREVNGQLDKQRKWLASSRWAAAAQFALAVSLTSSQNDLTRLEIEDENSILKKTRDAVITLQGVLEGKHDKTIEESLDQRQMSKDGWWSALYRMVEGLAIMSKLARSRLHQSDYGFEDRSIDWDQTEM

SEQ ID NO: 160 - protein, 210 aa, Gossypium hirsutum
GSFFVVILFVLLNGWLRICKRQRRDQELMEYEVVEEIIYGLESGILFGMASVISKIGFVFVQQGFSKMLIPLCVSISICCSGTGFYYQTRGLKHGRAIVISTCAAVASIVTGVLAGMLALGERLPSAPVARLSLLLGWLFIMMGVILLVSSTRLMRHLPWPLQNLIPSGADRNFSLRKTGSHRVKDPSPAAVIPAATLHHLIPTPAKEKA

SEQ ID NO: 161 - protein, 277 aa, Gossypium hirsutum
  misc_feature (204)..(204): Xaa can be any naturally occurring amino acid
  misc_feature (206)..(206): Xaa can be any naturally occurring amino acid
  misc_feature (271)..(272): Xaa can be any naturally occurring amino acid
AAVKELLGQYDQQSPAKENLKFSEECLQAISNNDVEDNVVPIVVRPGHIRFEPLEEEDAEQAIQHSQISVKTFQWNGITSKKKGQKWGMEKTPFLRRNDNNFSHVSSEMVDVNDKATVTNDMDFDKLMPYSSLPKEGDLVAYRLVELSSTWTPELCSFRVGEISHYDAESNRIMLTPVPGYPNASGKKTDEEASELPDTSLYGXDXSLEIDYSSLIDVRLVKLGNSNATIAIADDNNENYAQNQDVLTRQPNGSKEANSVSAAFPAQANGXXNYGRN

SEQ ID NO: 162 - protein, 370 aa, Gossypium hirsutum
FLAMANSKGSTNIRNFMVSGKHALLPPKSPFPTVSPAYTDYVPNNVIGSKAVQKPREGNTHHQCTSSESLRMEEQPSWLDDLLNEPETPVRRGGHRRSSSDSFAYIDASNAPNLDYAAQDEFRYQNMINTPSWASQDAKLSSLYSDVNLVKQKHRAWDSSLNVVTHPSGLPSLRENTFVQSLGSCAPQELERAQSTANGKQDSTKSVPIDAKASSEKKDNSHAKSSASDSDTKRAKQQFAQRSRVRKLQYIAELERNVQALQAEGSEVSAELEFLNQQNLILSMENKALTQRLESLAQEQAIKYLEQEVLEREIGRLRVLYQQQQNQQQPQQKQQSFSHRRSSSRDLDSQFANLSVKEKDTSSSHDTVTD

SEQ ID NO: 163 - protein, 143 aa, Gossypium hirsutum
VPFIQKLMAEVLGTYFLIFAGCAAVVVNVNNEKVVSLPGISIVWGLAVMVLVYSLGHISGAHFNPAVTIAFATCKRFPLKQVPAYVLAQVIGSTLAAGTLRLLFSGPHDVFAGTLPQGSDLQAFGVEFHHYFLPNVHYIWCCH

SEQ ID NO: 164 - protein, 250 aa, Gossypium hirsutum
  misc_feature (75)..(75): Xaa can be any naturally occurring amino acid
  misc_feature (156)..(156): Xaa can be any naturally occurring amino acid
  misc_feature (208)..(208): Xaa can be any naturally occurring amino acid
  misc_feature (236)..(236): Xaa can be any naturally occurring amino acid
IPGLFGYAIVQSQVRFFQSQSLVLPMMFSSLATLCSHIIVCWVLVFKFGFGSKGGALAISFSNWFNVILLGFYMXYSPSCEKTRTLHLKDVFLSVKEFFHFAIPSAVMACLEWWSFEILVLMSGLLPNSKLETSVLSICLSSDSLHYTISFGISVXASTRISNELGAGNPQAAQIATLVSMLIALVETLIASTILLCCRHVFGYAYSXENDVVIKVTRMVPLICLSFITDGLHGVXCGIVRGIGWQHVGA

SEQ ID NO: 165 - protein, 342 aa, Gossypium hirsutum
  misc_feature (36)..(37): Xaa can be any naturally occurring amino acid
  misc_feature (40)..(40): Xaa can be any naturally occurring amino acid
  misc_feature (72)..(72): Xaa can be any naturally occurring amino acid
  misc_feature (92)..(92): Xaa can be any naturally occurring amino acid
  misc_feature (113)..(113): Xaa can be any naturally occurring amino acid
  misc_feature (307)..(307): Xaa can be any naturally occurring amino acid
  misc_feature (313)..(313): Xaa can be any naturally occurring amino acid
  misc_feature (337)..(337): Xaa can be any naturally occurring amino acid
  misc_feature (341)..(341): Xaa can be any naturally occurring amino acid
MGLLLLFRFSLLVLLFFLLQHSPTKGEDFNAINNTXXSGXTRSLASNCNWFRGKWVYDPSYPLYDPYKCPFXEGEFDCQKYGRPDNTYLKYXWQPFSCSLPRFNGLYFLRKWXGNKIMFVGDSLSLNQFQSLTCMIQAWVPNSQISYIKRDGLTSVTFLGYDVNIMLYRTPYLVDIVNQKYGRVLKLDSIRGGDSWKGVDMLIFNTWHWWTHTGRTQPFDYIEDGGKTWKDMNRMVAFYKGLTTWARWVNRNVDPLKTKVFFQGISPTHYEGKDWNKPTESCSGQTQPFFGMRYPGGTPMAWVVVKXVLSRIXKPVFLLDVTGLSQYRKDAHPSAYXGMDXD

SEQ ID NO: 166 - protein, 224 aa, Gossypium hirsutum
MFAGDQNGLQGDPRLKAISEAIRVVPHFPKPGIMFQDITTLLLDHKAFKDTVDIFVDRYRDMGISVVAGVEARGFMFGPSIALAIGAKFVPLRKPRKLPGEVISESYVLEYGKDCLEMHVGAVQPGERALVIDDLVATGGTLSAAIRLLERAGAHVVECACVVGLREVKGQHGLNGKPLYILVEPRQQINCSAPSVNGVETCRHDDLILGASFGSPLNPTSKSD

SEQ ID NO: 167 - protein, 353 aa, Gossypium hirsutum
MEALNFLMFWKPSNGVHKVNQTQPCDGNGAAATVTVTATAASGVVSDHELDEGEDSFIDLEFPLRDFNGNGGARRELPNNVVGNKELSLSPADHFSKRKIMPIEPISKPQSPIALLKSAQRFRVFTPKKSKSMANTGNTTRLPEKTKLVGVSMETPKHENHNSREHFTRENSFRRTKGKIEDDPSKRLSKDLVHKYLNVIKPLYTKISKKHSQTHKFEVSGDLSTLSPATSPATVYSVKEKQGNTNIKAGYKHLGKSRSASAAASPISRRDDSLLLQHDGIQSAILHCKRSFNSSKESSWLSRCTSDCSSQEKLSNASSTEFSLFSRVASISSYEKLMDSARTSSEEGNGFTT

SEQ ID NO: 168 - protein, 429 aa, Gossypium hirsutum
  misc_feature (346)..(346): Xaa can be any naturally occurring amino acid
  misc_feature (363)..(363): Xaa can be any naturally occurring amino acid
MSRLSFRPRPLDIHKKLPIVKSVKDFEDDDTPTSATRNSQMLRLAAAEVEPEVQPLATKKLAPEIPTPQFVVVDTYERDYSRTFFQPTSYLRARGARAEIGEFVEYDLDNEDEDWLQDYNKDKKILAPEKLESLLFKLEVLDHKARERAGVITPTLVSPIPVLLTMDAAIEALQSQSIKYGVFQAVYNYWKEKRERWQKPILRRLQPPPPVNDNNPYNVFRPREKAHRLHTRRMQRRENNVQSFEKLRQVRRNLDQAKTLLEALIKREEKKRNVLECEVSLQRIQMKYKHETELLEDITLPGFPPISSKFASSEDEFMDSDDLANSRPRTRPAAVQNPPLTDSNVXMAPTASVKQEFRRRHLXHGWLHKLDPLEPVLLLTKPLVSDKLAAANIVPPSDSSTKMVPLHHPIIPWKMGRGGRNVFDRWKSS

SEQ ID NO: 169 - protein, 211 aa, Gossypium hirsutum
MTTQMKELEDPMALITQMYPCIYTQVAPQQGEISKPRRRQKKNKGGESGAATAAETAKKRKLSQEQVDLLELNFGNEHKLESERKDRLASELGLDPRQVAVWFQNRRARWKNKKLEEEYSKLKTIHEGVVLEKCRLESEVLKLKDQLREAEKEIQGLTERVDGVSSNSPSSSSVLSMEAMDPPPFLGEFGVQGFEDQDVFYIGMEWMNLYM

SEQ ID NO: 170 - protein, 417 aa, Gossypium hirsutum
RGTQVSGTVPDYLVRLSSLSQLVLSNNQLYGDLPQFKPNFSVYINGNPQLHRPKDNPPVLSKKRKSVGVTIVITFAAAVLAVVVVAIVFLLISKRLSKVNEEQLQSLEVFSPPRVIQGNMLTANGVHRSNIDFTKAMEAVANPANIVLKTRFSTYYKAMMPSGASYYVKKLNWSDKIFQLGSPDKFEQEIEALGKLSNSNIMIPLAYVLTVDSAYLFYEFSPKGTLYDILHGSLKSSLDWASRYSIAVGVAQGLAFLHGCTSSPILLIDLSSRSIVLKSLKEPQVGDIELCKVIDPSKSNGSLSTVAGSVGYIPPEYAYTMRVTMAGNVYSFGVVLLELLTGKAAVSEGTELAKWVLSNSVRPNKLDHILDFSISRTSLVVRNQMLAVLKVALACVSVTPESRPKMKSVLRMILNVR

SEQ ID NO: 171 - protein, 76 aa, Gossypium hirsutum
MGPWAVDLAPSVGIFPYVLKLLQTTTPELRQILVFIWTKILPLHLNEQLIRVLCQSFVYPQTLYCGKIVFVRGRNP

SEQ ID NO: 172 - protein, 100 aa, Gossypium hirsutum
MLLDYDPCSNYGNWTYGAGVGNDPREDRYFSIPKQAKTYDPDGEHVAFWVPELLPLPKEKRNFPGKSYIEQVVPLKFGSSNKHHSQRSKYGGRHSGLGNR

SEQ ID NO: 173 - protein, 74 aa, Gossypium hirsutum
QRKKVFRYVVFKINEKKKEVVVEKTGGQSENYDDLTASLPENDCRYAVYDFDFVTSENCQKSKIFFITWLVSVS

SEQ ID NO: 174 - protein, 188 aa, Gossypium hirsutum
HEEEDEQGTIGIALSKNLMAVAGEALKANISTLAPLVLPWSELLLVVTSLVARKFFTKKVKPYIPNFKVAFEHFCIHAGGKAVLDELQKSLNLGEWQMEPSRMTLYRFGNTSSSSLWYELAYSEAKGRINNGDRVWQIGFGSGFKCNSMVWKALKNIHPLVEKNPWMDEIHDFPVILPKHEPLSSSTI

SEQ ID NO: 175 - protein, 137 aa, Gossypium hirsutum
PAHRKSKRFEVVQRRIRRPFFVAEVEALVQAVEKLGTGRGGDVKLRAFDNGKPRTYVDLKDKWKTLVHTARISPQQRGGEPVPQELLDRVLTGHAYWSQQQAKQQLKQQQQPESSLFLYNSTVRASSRSDGGEKNFG

SEQ ID NO: 176 - protein, 234 aa, Gossypium hirsutum
MSGRSFLRGTESKEKLLPRKGYSEFGFNSSDVSEDRVKCSCFRSCCDSIDNFWSGLQELFVKLYEMGRSDPRKVIFATKMGFSLMSISLLMLFKEPLKETSQYSIWAILTVVVVFEFSVGATLNKGFNRAIGTFSAGALALGIAQVSTLSGKYEEIIILISIFIAGFAASYCKLYPPLKTYEYGFRVFLLTFCIVLVSGNNSRTFFRTAFYRLLLIFIGAGLCLIINICIYPIW

SEQ ID NO: 177 - protein, 257 aa, Gossypium hirsutum
MSSAAVGTFSASKQIGFNKNETKAGEEEELRDEKNKKFIDDNDEEAINNGGKPHDDQHDEEEEDDDDDDAKLKSEKELDLGPQFSLKEQLEKDKDDESLRRWKEQLLGSVDMSAVGESKEPEVKILSLSIVSPGRPDIILPIPFVTKPKTCLFTLKEGSRFRLKFTFNVSNNIVSGLKYVNTVWKTGIRVDNTKIMLGTFSPQKEPYTFELEEETTPSGLFARGSYAVRTKFVDDDDKVYLDVSYHFEIQKNWGSRP

SEQ ID NO: 178 - protein, 223 aa, Gossypium hirsutum
QVLASMLLEKAKHEHEGHVLKQYRSKAEYYLCSCLNKNNATSDNVERTPGGLLYIRQWNNMQYVSTATFLLTVYSDFLRNSKQHLRCPTGTIDTEEILSFAKSQVDYILGSNPMNMSYLVGYGSKYPIRVHHRGASIVSYRENKGFIGCTQGYDNWYSRVEPNPNVLVGALVGGPDCRDNFMDQRDNYMQTEACTYNTAPLVGVFARLLQLEENLEVELVASY

SEQ ID NO: 179 - protein, 263 aa, Gossypium hirsutum
FADKFKFGNLSDEVAYIFAKAVQVASGVVFVGTVFALFKAISWHRSKSTSSCLSLVSPSKGTKNQPNLTKRQLGLLGVKSKVEQVAPDSSKKPPKSKPLAALSSSDVLVPLHPSISGSDRKSLASSNKSNTSGGNKMSPFATPSRSQGSPSSLYLVPASTSSLSSRQTSPGQEPLVKTPWSTKRSSYAKEITTEEQLEQFLAEVDEKITESAGKLATPPPTISGFGIASPNTVASSANTSGTTRSTPLRPVRMSPGFPKIYHS

SEQ ID NO: 180 - protein, 122 aa, Gossypium hirsutum
NGTHKSHVHSPYEAAILASYKPVVNVTTLIPSLRQVEETTKKGLEYFKSTRHIILYYEDVVKNPPKLAEVQEFLKVPKRELKSRQVKIPKGSLSNPIQNWVDVEKALNGTKYESYLHADYRK

SEQ ID NO: 181 - protein, 113 aa, Gossypium hirsutum
MASKPFIALATTVLFFSLIAVNHFGKPFHGKLGEMEIVPITDAVGPESVAFHPLGDGPYVGISDGRIIKWQPNEHRWISFGITSPNREGCEGTDDHETREHTCGRPLGICFHE

SEQ ID NO: 182 - protein, 181 aa, Gossypium hirsutum
LIQYPPPDLSSATQTRYIAMYEYTSDTDEPTHLYINGKPYEAPATETPKAGTSEIWNVINLTEDNHPIHIHLAVFTVLDQTELVKAEEFKACMSKMNDAIKCQISKHARGKKLRVAAHEKGWKNVYKMTPGYVTRILVRFSYIHSNTSYSFDPTGMPGYVYHCHILDHEDNAMMRPLVVMK

SEQ ID NO: 183 - protein, 211 aa, Gossypium hirsutum
SIVLHSQHLRNKQRKMANLRCLTKHFICACQLLFLLQAEVFCSQYKVGDLDAWGIPTSANPQVYAKWSKNHSFKLGDSLLFLYPPSQDSVIQVTEQSYNSCDLKDPILYMNNGNSLFNITKPGEYFFTSGEPGHCEKKQKLYIAVLSGNGSAALAPSYGPSALPDTASSPSYTTVFGNIPQPPSSSPSLGFPLFVTAVVASATWGIINAMI

SEQ ID NO: 184 - protein, 72 aa, Gossypium hirsutum
ARLFNEAAQMSPEDADVHIVLGVLYDLSREYDKAIASFKTALKLKPNDYSLWNKLGATQASVQSADAIINRH

SEQ ID NO: 185 - protein, 293 aa, Gossypium hirsutum
  misc_feature (102)..(102): Xaa can be any naturally occurring amino acid
  misc_feature (118)..(118): Xaa can be any naturally occurring amino acid
  misc_feature (120)..(120): Xaa can be any naturally occurring amino acid
  misc_feature (133)..(133): Xaa can be any naturally occurring amino acid
  misc_feature (143)..(143): Xaa can be any naturally occurring amino acid
  misc_feature (146)..(146): Xaa can be any naturally occurring amino acid
  misc_feature (155)..(155): Xaa can be any naturally occurring amino acid
  misc_feature (199)..(199): Xaa can be any naturally occurring amino acid
  misc_feature (202)..(202): Xaa can be any naturally occurring amino acid
  misc_feature (230)..(231): Xaa can be any naturally occurring amino acid
  misc_feature (234)..(234): Xaa can be any naturally occurring amino acid
  misc_feature (255)..(255): Xaa can be any naturally occurring amino acid
  misc_feature (267)..(267): Xaa can be any naturally occurring amino acid
SNHSSSSPFNKFPKSFSTIFPSATSAFTTYASISASLMLLRSIFNDLIPYPLRKHIFSAISPLFCFFSGKQTIIIDQSDGIEPNHVFNATELYLSTKINPNXKRLKVSKRIKDKGLSXKXDKGQRITDSFNGXELKWRHVCYXVEXKGNVTEKRXFMLRFKKNNGDLVMNSYLPFVLKSAEMIENEMRVLKIHTLGNVXYGXKFKWESIKLEHPSTFETLALDPELKTMXXDDXNRFIRRKEFYKKVGRSWKRGXLLYGPPGTGKSXLVAAMANYLKFDIYDLQLENIKVIRI

SEQ ID NO: 186 - protein, 218 aa, Gossypium hirsutum
MAGYRAEDDYDFLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVPTEDAKSFAEKESLYFMETSALEATNVENAFAEVLTQIYHIVSKKAMETSDEGAASAVPSKGEKIDVSKDVSAIKKGGCCSS

SEQ ID NO: 187 - protein, 515 aa, Gossypium hirsutum
AGTHTSFSYLLNYFSISCNMPPASPDFSSSVKLKYVKLGYQYVVDHFLTLLLVPVMVGILIEVVRLGPQEIVNLWNSLHFDLIQILCSSFFIIFIATVYFMSKPRCIYLVDYACYKPPVTCRVPFATFMEHSRLILSNNPKSVEFQMRILERSGLGEETCLPPAIHYIPPKPTMEAARGEAEVVIFSAMDSLFKKTGLKPKDIDILIVNCSLFSPTPSLSAMVINKYKLRSNIKSFNLSGMGCSAGLISIDLARDLLQVHPNSNAVVVSTEIITPNYYQGNERAMLLPNCLFRMGGAAILLSNRRSERRRAKYRLVHVVRTHKGADDKAYRCVFEEEDKDGKVGISLSKDLMAIAGEALKSNITTIGPLVLPGSEQLLFLLTLIGRKVFNPKWKPYIPDFKLAFEHFCIHAGGRAVIDELQKNLQLSAEHVEASRMTLHRFGNTSSSSLWYEMSYLEAKGRMKKGDRIWQIAFGSGFKCNSAVWKCNRTIKKPTDGPWEDCIHRYPVHIPEVVKL

SEQ ID NO: 188 - protein, 495 aa, Gossypium hirsutum
TKSPSISHKTMKKNNHLSPPLPWTTPFIILSILTVHSIKITSAACHVDDEKGLLAFKSGITQDPSGMLSSWKSGTDCCNWAGINCRENNRVTTISLYGQVDKPDSYLTGTISSSLVKVQNLDGIYFVNLRNISGPFPDLLFGLPKLLYVYIENSKLSGSLPVNIGKLKQLGALSLEGNRFTGSIPSSISELTQLTQLVLGKNEFSGHFPAGIKQIRNLSYLSLEQNKLMGTIPDIFKSFTDLRILRLSHNEFSGKIPESILSLAPKLAYLELGHNRLSGQIPSYLGKFKALDTLDLSWNSFTGVVPKTFSNLTKIFNLDLSHNSLNDPFPQMNVKGIESLDLSYNNFHLKEIPKWVTSSPIIYSLKLAKCGIKMNLDTWKPAETYFYDYIDLSENEITGSPVDLLNRTDFLVEFKAAGNKLKFDLGKLRIVKTLKELDISRNLVYGKVPAAINGFNKLNVSYNHLCGQLPKNKFPVSSFVGNDCLCGPPLSPCKL

SEQ ID NO: 189 - protein, 843 aa, Gossypium hirsutum
MVEPRRLLMIFFLSTLLIAYSNANVEEIQKDTEEGDEEGKVGGQKAQGVTYDARSLIINGKRELLFSGAIHYPRSTPDMWPDLIKKAKQGGINTIETYVFWNGHEPVEGQYNFEGEFDLVKFIKLIHEHKLYAVVRVGPFIQAEWNHGGLPYWLREVPDIIFRSDNEPFKKHMKRFVTMIVDKLKQEKLFAPQGGPIILAQIENEYNTIQRAFREKGDSYVQWAGKLALSLNANVPWIMCKQRDAPDPVINTCNGRHCGDTFYGPNKRNKPALWTENWTAQYRVFGDPPSQRSAEDLAYSVARFFSKNGSMVNYYMYYGGTNFGRTSASFTTTRYYDEAPLDEFGLQREPKWGHLKDVHRALSLCKRALFWGVPTTLKLGPDQQAIVWQQPGTSACAAFLANNNTRLAQHVNFRGQDIRLPARSISVLPDCKTVVFNTQLVTTQHNSRNFVRSEIANKNFNWEMYREVPPVGLGFKFDVPRELFHLTKDTTDYAWYTTSLLLGRRDLPMKKNVRPVLRVASLGHGIHAYVNGEYAGSAHGSKVEKSFVLQRAVSLKEGENHIALLGYLVGLPDSGAYMEKRFAGPRSITILGLNTGTLDISQNGWGHQVGIDGEKKKLFTEEGSKSVQWTKPDQGGPLTWYKGYFDAPEGDNPVAIVMTGMGKGMVWINGRSIGRYWNNYLSPLKKPTQSEYHIPRAYLKPKNLIVLLEEEGGNPKDVHIVTVNRDTICSGVSEIHPPSPRLFETKNGSLQAKVNDLKPRAELKCPGKKQIVAVEFASYGDPFGACGAYFIGNCTAPESKQVVEKYCLGKPSCQIPLDSIPFSNQNDACIHLRKTLAVQLKCA

SEQ ID NO: 190 - protein, 468 aa, Gossypium hirsutum
AYCCRHHSINFLQRPLLFLLVFQFLHCQTLPQSSITFFFFVQTTEMKSLSPSNNLYFFLLHFFIITVYFASLSFGLKIGETCSSSGSSSSCDSGLTCQTCAANGNTRPRCTRIQPLSPTSKVKGLPFNKYSWLTTHNSFALKGVKSETGSSIIAPTNQEDTITNQLKNGVRGLMLDMYDFNGDIWLCHSFGGQCFNATAFQPAINVLKEIQAFLEANPSEIITIFIEDYVVSPQGLTKVFNASGLRQYWFPVSKMPKNGEDWPTVDEMVKQNQRLVVFTSKSAKEASEGIAYEWRYVVENQYGDDGMKAGSCPNRAESSPMNTKSRSLILQNYFPTNPNETAACAENSAPLVKMLDTCHKAAGDRWPNFIAVDFYQRNDGGGASEALDVANGHLTCGCDNIAYCKANATSGTCEVPPMSPPPPAATTQTTTENPSASNSNIANTDARPLQLRWLLATILTKLLLLQLW

SEQ ID NO: 191 - protein, 429 aa, Gossypium hirsutum
MRINWKSWSLNKDHLVKLAIGILLVGFACKLLVFRSKGFGADLEFPEVEKEYVQKPDLEPPVPVQIPENDDQMPLDVVIEKCDLFTGDWVPNPSGPTYTNESCPLIEGHQNCMRNGRPDSGYLHWKWKPRDCQLPRFNAERFLELTRNKAWALIGDSISRNHVQSLLCMLATVERPVEVYHDEQYKSKRWHFASYNFTVSNIWSPFLVKAAVFEDNDGVSTAEVQLHLDKLDKTWTDLYPSLDYMIISTGKWFLKAAIYHENDTEVGCHICPGKNLTELGFVYAYNKTLHYVMDFIANSKHKGLIFFRTSTPDHFENGEWHNGGSCPKTTPAKEGEVEIKDLSRILRNVELEEFEKAAAKAANNGVNLKLLDFTNLLLMRPDGHPGPYRQFQPFAENQTAVVQNDCLHWCLPGPMDFWNDVIMEMVVRG

SEQ ID NO: 192 - protein, 317 aa, Gossypium hirsutum
MEDIKPLIEALKTKLKQALILWAEGFREACCLHRVIVLCRRSKKLMIRTGQCFLLNGFIFLGSLFVLNSVVIPTLQWILPDHYSQTSCEAMSEFHGVFKFYSFLRGFLIQLFYVFWFYPLYVFSFILSNLWYNDIATHGFAAMGRSRPSTVESLKQNDTLTSDSKVHAARPAGLGRIMIGIGEQVYSLLLLTFFFFEVYATGFIPYIGKALNFVLLSWMYAYYCFEYKWNFTEWGLEKRLDFFETNWAFFAGFGSPCVLAIFFFPPLVGYGFMAVLFPLFVLTATGTEAEQVISTRRRRLPVHNWGRFQYFTQLTLY

SEQ ID NO: 193 - protein, 190 aa, Gossypium hirsutum
  misc_feature (10)..(10): Xaa can be any naturally occurring amino acid
  misc_feature (12)..(12): Xaa can be any naturally occurring amino acid
  misc_feature (18)..(18): Xaa can be any naturally occurring amino acid
  misc_feature (43)..(43): Xaa can be any naturally occurring amino acid
  misc_feature (50)..(51): Xaa can be any naturally occurring amino acid
  misc_feature (61)..(61): Xaa can be any naturally occurring amino acid
  misc_feature (103)..(103): Xaa can be any naturally occurring amino acid
  misc_feature (157)..(157): Xaa can be any naturally occurring amino acid
  misc_feature (173)..(173): Xaa can be any naturally occurring amino acid
  misc_feature (175)..(175): Xaa can be any naturally occurring amino acid
MNTHSLKLLXIXLTITFXSTQCDDDLVDQICKKTPFYDLCISXLKSNSNXXDVKGLASVMXDTMLSNATDTLSYIRAEINRTPDPKIERALAYCAELYIPVVXYNLPQAIDALSKGQFEFAADGISDAAKEADSCEKMISWSQELAALSDRNKLIHXLSDVAVAIVKILLKGXWXLKLWGILVTSCLCVI

SEQ ID NO: 194 - protein, 304 aa, Gossypium hirsutum
IKLIITGSAKLQMATQLPDFMLIFVISCLGFISLCKPILGFIKWVWVMFLRPPKNLKHHYGSWAIVTGCTDGIGTALAFQLASKGLNLVLVGRNPLKLVATADAIRENFGAQVGTRNVVIDLAKTSGEEISKTMEDAIEGLDIGVLVNNAGLAYEGARFLHEVDSEVAESIIKVNIVAATWITKAVVPIMAKKKKGAIVNVRSGSYGGFCSYPLYTIYAATKAYLTMFSRSINLEYKKIGIDIQCQVPLFVATKMTKFKTSSLFIPSAEMFSKASLRWVGHDEHLCVPYWPHSLQCFVLNALPG

SEQ ID NO: 195 - protein, 164 aa, Gossypium hirsutum
  misc_feature (149)..(149): Xaa can be any naturally occurring amino acid
  misc_feature (152)..(152): Xaa can be any naturally occurring amino acid
  misc_feature (162)..(162): Xaa can be any naturally occurring amino acid
MCPYLDNLGFGPEIENPEDVLINNSWFLTNQFLLEVIFHNKMKRYECLTNDSSIASAIYVPFYAGLDMSLYLWGFNTTVRDSASLGLVKWLSEKPEWKRMWGRDHFLVAGRIAWDFRRQSDNETDWGSKLRFLPESRTCRCCLSNRALXNDXASYPTCFHPXRK

SEQ ID NO: 196 - protein, 298 aa, Gossypium hirsutum
  misc_feature (67)..(67): Xaa can be any naturally occurring amino acid
  misc_feature (70)..(70): Xaa can be any naturally occurring amino acid
  misc_feature (209)..(209): Xaa can be any naturally occurring amino acid
  misc_feature (228)..(228): Xaa can be any naturally occurring amino acid
  misc_feature (234)..(234): Xaa can be any naturally occurring amino acid
MAEKKWILILFLTFIIAVSQVHHLYMGELASIMLEKLQQWRKPFNNGGKNLAIGPNLTACHSSYGRXDLXVYCCPPGFQTPVPFTDFKFPDPSPVRVRRPAHLLNESFIAKYNKALSIMKSLPYDDPRSFLRQANLHCQFCTGAYEMLNRSGSELNIHRTWMFFPWHRMMIYFHERILGSLIGDDTFALPFWAWDIPDGMTIPDFYVDXSSPFFHSQRDFSHFPPRVXDLDYSXDDNDPRFDGKEQTETNLAFMYNRMVSGARKRSCSWDVHIKPRQTVIAGTIESAPHILTYMDRVG

SEQ ID NO: 197 - protein, 345 aa, Gossypium hirsutum
MVAPLSAWPWEHLGIFKYILYGPLAAKAWYSWMYEDNILKDLWCIHILLICTLRGFIHQLWSSYNNMFFLTRNRWIKQQGVDFKQIDDEWDWDNFIILQAMLASMACLIFPSLNTLPLWNLKGFIASLLLHVTISEPLYYWAHRLFHKPYLFIHYHSLHHSSPVPHPFTAGHATPLEHLVLCTVIGIPITGSILMGYGSTAMIYGHVLVFDFFRCLGHSNAEVGPHEVFNKLPLLRYFIYTPTYHSLHHTEMETNFCLFMPLFDALGNTLNTKSFELHKRITSNSRKNGRVPDFVFLAHVVDIMSAMHTPFALRSFASTPFCIKMFLLPFWPLTFMKIACDVGLV

SEQ ID NO: 198 - protein, 301 aa, Gossypium hirsutum
MSTVVHRTPKSGRQSLFYQDLASPISARRGKFSSPGQAAAVSALWQENFGSSDLPPPPMYTLEDRSDFSPESRILDYPMSPEIKSDPKSPVQSSGHDFSTPAKSKSGASTSFAILNGQQNQQSPASLSWWSPAKNSSSNEQDDKGKGSPVEGVVQPGALITLPPPREVARPEIQRNSVPAGNLDEEEWVTVYGFSPADTNLVLREFEKCGVILKHVPGPRDANWMHILYLNRSDAQRALSKNGMQINGALIIGVKPVDPMQREALNERINNQGFMTLPPPSSGTPELSNFRPSRPIVSSSA

SEQ ID NO: 199 - protein, 203 aa, Gossypium hirsutum
MVGKKSYLAMRSEREATDLIVSDFQDLIFATKKLANHAIKLGSWGFGTTLLEWIASFAAIYLLILDRTNWKTNILTALLIPYIFLSLPSFLFNILRGEVGKWIALIAVVLRLFFPRRFPDWLELPGALILLIVVAPSLFSSTIRNDWIGVVICLGIACYLLQEHIRASGGFRNSFTKANGISNTIGIIILLVYPAWALVTDIL

SEQ ID NO: 200 - protein, 271 aa, Gossypium hirsutum
NWTVGMVGILAGTLEDALIVYADISGQLPSHEPTILPPKLLFPLLNSTNPISEIKFARYGEWFNDCSDEIRICCSNALHLLCEHYKWKTVEVTIPEIESMRLAHYLTIGSECTTSLSSALEKLDFAELGWDARVALRVYGAFNSKEYIKAQKMRNRQMQIHKNIFAKADVIVAPTTGVTAYSIFDDALKTGELDYINGAALVRYQIAGNFLGLPAVTVPVGYDKEGLPIGLQFIGKPWSEPTLMHIAFAMQALCISHYRKPKVFYNLLHKN

SEQ ID NO: 201 - protein, 322 aa, Gossypium hirsutum
MEGIQHKTVIVNGINMHIAEKGEGPLILFLHGFPELWYSWRNQINGLAALGYRALAPDLRGYGGTDAPDSVADYTCCHVVGDLIALLDTVAPPEKEDKVFVVGHDWGAIIAWYLCLFRPDRVKALFNLSVPFIPYDPRFKPVETWKAFYGKDHYIVRFQEPGVIEAEFAEIGVGRAVLELLSYRVPDPLYLPKGNLFGHPLDSPVNLPPWLSEKDADYYATQFQITGITGALNYYRNFDRNWELSAPWWKSQIKVPVKFAMGDLDLVYTMPGMKDYIHNGGFKRDVPFLEEALVINGVSHWIHQEIPDQINQLLFDFFSKFH

SEQ ID NO: 202 - protein, 175 aa, Gossypium hirsutum
MDLCKTIGQGKRLPCWWGNGMKAMYYVLGDPTMKPKGYDPMTEAVLLWERDKSATKTRYNLTSFAISLNELTPDLLEKLPPTDSRLRPDQRHLENGEYEMANAEKLRLEQLQRQARKLQERGWQPRWFNKDEDGCYRYIGGYWEAREKRKWDGIPDIFGQCSGSSHNSPSCLIEE

SEQ ID NO: 203 - protein, 400 aa, Gossypium hirsutum
  misc_feature (255)..(255): Xaa can be any naturally occurring amino acid
  misc_feature (339)..(339): Xaa can be any naturally occurring amino acid
MKQPPPLFFLLFLLSATIASAATTPTVSPTPSPTSSPTPPTTKAPSSSSSPLDPEQMKTLRSLHIPTTRDPCIQPSPRNATICDNSKPLRHLISLHLSNCSSDLFLSSAALKSLSSLRSLSFTDCQVSPVRFPSQLSLSLTSFSCIRSLRRLSGVWLSRFVNLTDLRVSYTPVKASGLYVILGHMHQLKTLTISHANLSGSLPRHLNPDLTHVDVSDNKLKGKVPTSLTLLEDLKFLNLSSNGLDGEIPTELGNXISLKNLSLASNSFSGSIPSSFSAIPGLVHVDLSNNQLNGSVPKFLSELKGLKVLNLENNQLNGVLPFNASFIKRLAVFKVGGNXNLCYNHSVLSSKLKLGVARCDKNGFPIVAPPPKESSADSESDYGDDDAVDSGNKKEKHHGP

SEQ ID NO: 204 - protein, 493 aa, Gossypium hirsutum
MNGEKNSSNNRVLKLKYVKLGYHYLITHLLKLCLVPLMAVIIVQASRLSLNDIHQTWLHLEHNLVYVVVLSAFVLVGSTVYFMTRKRSVYLVDYACYLPPSKLKVEHDRFMKHCKLMGCFDETSLVFLDKILGRSGLGEETCAPEAMHCLPPKPSMEAARQETEQVMFGALDTLFANTNVKPKDVGILVVNCSLFNPTPSLSSMIINKYKMRGNIKSFNLGGMGCSASVISVDLAKDMLQVHRNNYAIVVSTENITQNWYFGNKKAMLLPNCLFRIGGAAVLLSNKSLDRLRSKYKLIHVVRTHCGANNKAFNCVRQEQDDIGKTGVSLSKDLMTIAGNALKSNITTLGPLVLPISEQILFFVTLVANKLINAKIKPYIPDFKLAFEHFCIHAGGRAVIDELEKNLHLLPVHVEASRMTLHRFGNTSSSSIWYELAYMEAKGRMQKGDRVWQIAFGSGFKCNSAVWLALKNVKPSCNSPWEGCIHRYPVQLSL

SEQ ID NO: 205 - protein, 273 aa, Gossypium hirsutum
MAGPAPFVDLGKKAKDLLTKDYNFDQKFTLSMLSTTGMGLTATGLKKDQNFFGDINTVYKSGNTTVDMKVDTYSNVSTKVTVNDVWPCSKAALSFRIPDHKSGKLDVQYLHPHAAIDSSIGLNPTPLLELSATIGSKELALGGEIGFDTASASFTEYTAGINLNKPDFSVALLLTDKGQALKASYIHSVNPFTCVAAEMAHRFSTYENTFTIGSFHAVDPFTVVKTRFFDNGKVAMLCQREWRPKSLVTFLAEYDSKAINASPKMGLALAFKP

SEQ ID NO: 206 - protein, 191 aa, Gossypium hirsutum
  misc_feature (184)..(184): Xaa can be any naturally occurring amino acid
GRGTSNTYCVAKYGHKWVRTRTLVDNLSAKYDEQYTWEVFDPATVLTVGVFDNSQLGEKGSNGNKDLKIGKVRIRISTLEAGRVYTHSYPLLVLHPTGVKKMGELHLAIRFTCISFVNMLYQYSRPLLPKMHYVRTFSVMQLDMLRQQAVNIVAARVGRAEPPLRKEIIEYMSDVDSHFGACVXTKQMSSG

SEQ ID NO: 207 - protein, 549 aa, Gossypium hirsutum
MELTDLQSNKQTKNNSSSSNNNNNNSAEPHHQSLQQHHLQHQKQSASPQLVVPFDGTRSSGPSSGNPFNMGSISHLHPHHPFHHLLLHPASSTTTTTTTPPLPSSSSSSSSSSSASTTTTNPPQLVDASLAIATRSTSLNIDSKNQTDLPISSTTTPASTTTTTTTANPPVKRSTKDRHTKVDGRGRRIRMPATCAARVFQLTRELGHKSDGETIEWLLQQAEPAIIAATGTGTIPANFSTLNISLRSSGSTLSAPPSKSAPHSFHGALALASHHHHHHPYEEGFAHSALLGFQQQHLLTADQIAEALPGGGGGDGGNLSENYMRKRFREDLFKDDDQQQGESGSGGGDGSPIKAFKSGLTQLSKPQQDAGSSALPRPSNILPGTAMWAVAPAPSSGAGSTFWMLPMSAGACGPSVAPSAATGAGPSDHPQMWPFGTANQASGNTLQAPLHFLPRFNLPGNVEFQGGRASPLQLGSMLMQQQHQQQQPHHHLGLGMSDSNLGMLAALNAYSRGGSNVNSDQNNPLEHHHQQHQPQGTDSGDDQDPNTSQ

SEQ ID NO: 208 - protein, 386 aa, Gossypium hirsutum
KVRVPNLFVSLLKIRMATSLCTHVPALFLLLLLVSAPCNAGILRTCKFDAIYQLGDSISDTGNLIREHPFSPFARLPYGGTFFKHATGRCSNGLLIIDFLALSAGIPFLQPYLNSNALFTRGRGVNFAVAGSTALPVETLADKGVVAPVTNSSLSRQLDWMFTHFNGICHDEDDCLEKLKTALFIVGEIGGNDYNYALFQGKSFDQVRSMMPLVIQAIKDAVTRVVGYGATRVIVPGNFPIGCFPVHLTVFRSNDSDAYDGFNCLKDLNNLSSHHNGLLKQAIKELRKELPHATILYGDYYNGYMRLLNKAKFLGLDPNSTQKACCGIGGDYNMELNKMCGAAEVGVCKNPDEYISWDGVHLTQKAYQLISGWLIHGVYWKLRCGV

SEQ ID NO: 209 - protein, 50 aa, Gossypium hirsutum
MLTSLLVLLYINKRKTEATYTTSASIGMRNWNAERIFSYKEIKAATNNFK

SEQ ID NO: 210 - protein, 208 aa, Gossypium hirsutum
GASALVKSVHPKWTSSMIRSALMTTATVYDNMRKPVTNGSASFATPHEMGVGEIIPVKALNPGLVFETTTEDYLRFLCYNGSPEKTIRSMSKTKFKCPTKSSDDLISNINYPSISISKLEKSIGFLTIKRSVTNVGHPNVTYTSTVQAPMGMKVKVIPKKITFLENVKKVSFKVLFDGSEASSGYNFGSITWSAAQYSVRTVFAVNVE

SEQ ID NO: 211 - protein, 289 aa, Gossypium hirsutum
EMESELNNLIKLWVLTTFSLSYSYHISAKISKGFPRLVSIFPVIFLLSILPFNIHGFHLGAAHVFVLSWMANFKLLLFAFDRGPLSPPPENFILFILAACSPFKIKENSVKVLKGETPFQGNQPRVPSLILEAVNKASLLTLLFYSYNFKQYFHKHVLLILYFFHTFLSIQFLLAVAAIPAQICLPGVELEPQFNAPLRATSLQDFWGRRWNLRVSEALRLTIYSPIKTISSRVIGSRWASLPAVFATFVSSGFMHELIYYHIIRKKPTWEITWFFVLQGVLVDIEIFL

SEQ ID NO: 212 - protein, 272 aa, Gossypium hirsutum
  misc_feature (42)..(42): Xaa can be any naturally occurring amino acid
RTIKCAPQAARPSSIVKTLVGKRRQILRSLIPGGEFMNGVSXILIHFLGSVELLSLSATSFPLLLSRLNFLLFSLSIQEQVLARMRSPFSLKQEFLKKWILGLQRCRSSKKNMSIFERKKVIKLSADVAMASARKGTTCWSRALIADAVKEGNADKHLAEKILGPASERQPTKKVPVGAMAYNKRIRSKKILKRSSVIRRTIKCAPQAARPSSIVKTLVGKRRQILRSLIPGGEFMNGVSLIEETLDYIISLRAQVDVIRSLASASKLVNLN

SEQ ID NO: 213 - protein, 239 aa, Gossypium hirsutum
KSQGQTKANIRFSMEGEAGSYEDVKPNVVAKQSNGDVVGDNGVGNLGSVEAPDFLSKKNFQNCSVATPASGLNSTSPAPSQLTIFYDGHVCVFDAIPVEKVREIMLIAATGAANSVDMKKVATDCATTSPVLTRSPSLQSTATATALASPQAQVYPTNRTPFCKLKELPIARRHSLQRFFEKRRDRLVNRNPYPNPSTPKSFDDTKANLSAATSSESGCFGKSPVAQEEFHPKAPAHVA

SEQ ID NO: 214 - protein, 83 aa, Gossypium hirsutum
MDLSRNSLTGTLMLTFGCNLTSLLKLDLSNNKLEGKIPEGIGRLKNATLLDLGRNKFSGGLIQSFQRLVSLKEMVISNNPLGR

SEQ ID NO: 215 - protein, 108 aa, Gossypium hirsutum
  misc_feature (6)..(6): Xaa can be any naturally occurring amino acid
  misc_feature (13)..(13): Xaa can be any naturally occurring amino acid
  misc_feature (16)..(16): Xaa can be any naturally occurring amino acid
  misc_feature (26)..(28): Xaa can be any naturally occurring amino acid
  misc_feature (31)..(31): Xaa can be any naturally occurring amino acid
  misc_feature (41)..(41): Xaa can be any naturally occurring amino acid
  misc_feature (43)..(43): Xaa can be any naturally occurring amino acid
  misc_feature (45)..(45): Xaa can be any naturally occurring amino acid
LKPLKXPHLVAGXVYXKFKVSYVCLXXXTMXELPTQSTSAXAXPXLQLNRGSTTATSGPESKPKKKICCACPETKKLRDECIVEHGEEACAKWIEAHRICLRAEGFNV

SEQ ID NO: 216 - protein, 389 aa, Gossypium hirsutum
MSCSSPMRKTSCLSRRFSRSLRLSARTAALTTVSTRENHLESSSTSSPSSPPPLAEAGGDSWSTLLPELLVEIMERVEASEEMWPDRKNVVSSACVCKKWREVTREIVKASSQNSGKITFPSCLKQPGPREFPNQCIIKRNKKNSTFFLYLALSPSFTEKGKFLLAARRYRHGAHIEYIISLDPNELSQGSNAYVGKLSSDFLGTNFKIYDSQPPHSGAKPSSSRASRRFASKQICPQVPAGNFEVGQVSYKFNLLKSRGPRRMVCSIQCPLPEDMADEKYLDDIKMKMPEHASSGHTILRNKAPRWHEHLQCWCLNFHGRVTVASVKNFQLAATVEESQLGGKEEEETVLQFGKVGDDTFTMDYRQPLSAFLAFAICLTSFGTKLACE

SEQ ID NO: 217 - protein, 335 aa, Gossypium hirsutum
ICIYPIWSGDLLHKLVVKNFKNVASSLEGCVNGYLQCVEYERIPSKILTYQASDDPLYSAYRSVVQSSSQEDTLLDFALWEPPHGPYRSFNYPWRNYVKVSGALRHCAFMVMAMHGCILSEIQAPAEKRHVFALELQRAGNAGAKVLRELGQKVEKMEKLIPGDILREVHEAGEDLQMKIDEKSYLLVNSESWATAPPHRELEESGSMADVKDNEHKVIKSLSDMWEVQHTIDPRAPDLITSESMLQKPSWPRLSFTAEALLQQQESKIYESASALSLATFASLLIEFVARLQNLVDAFQELSEKANFKVPVDQSPQKEAPGFWRRLRNCFQSKN

SEQ ID NO: 218 - protein, 361 aa, Gossypium hirsutum
  misc_feature (81)..(81): Xaa can be any naturally occurring amino acid
  misc_feature (289)..(289): Xaa can be any naturally occurring amino acid
  misc_feature (295)..(295): Xaa can be any naturally occurring amino acid
MAFAESQNPLRVHRIQQSRYIDAVRWLSPVSPSDRFAAIAYFDADTNSPSIEIAYVDPNPQSSSPTLTPQSSWTSPSRISXLRTAHSTPQPLLAAATFSGSLHILASDLINGGVMESEATVSELGFHSGPVSAVDLREGGTECVSVGEDGRVNLVSFVGDSSKLNYRRIFDSNGLVGYTAVKWASPSEFATGGYGFGIQWWDQRTPGGPVLQFKGNWCQGKTSGIVHSIDIHPSRKHTCLAGGSSGTVFAWDRRAAQQPIVLSGAGTGEAPNSLLSESEVWEVQYDRYXRRSNIXNISSTRILPVMICSEDGILAVIEQGEEPLELLAEPCAINSFDIDRQNPSNVICSLEWESLAILTRS

SEQ ID NO: 219 - protein, 215 aa, Gossypium hirsutum
NTTMQWSPFENFSAFGDSSAMSTKWQDGHEVQAPPVATGTQSWNAFNDSVESLPLEPQVVAYEHMATTDEHLGLAVSENHDNYGIQTADSHIGFPAATLPSENGIAPLYAPSMNPLPGEKETQAADLKPTNPFDLPFDSELEQSDMFFDMSSLQSTLPNAQLPSTFLGVSQPWLPQNPTPPQGGLVYMSGQTPSSQLPNVPAQGPVASIGGNPFA

SEQ ID NO: 220 - protein, 150 aa, Gossypium hirsutum
MENLVPSVMSRIEVLALEGLRIQCGMSDEDAPSSISPFSSSNMPFIVGKDSNFSKLLSFEGAASSNSLDLDFEYDFDYVNRLMSLSITLDEWLRLDAGIIDHGDHISDHKIQILEAHQAKCLDSVSGKLIKRVNLGKASGRQHGLLGNNF

SEQ ID NO: 221 - protein, 147 aa, Gossypium hirsutum
  misc_feature (6)..(6): Xaa can be any naturally occurring amino acid
QIEFLXWRTTKSRKWRSWPTRSTARSPRRHPPPIPTTISALTLVPSLSRPKLYRLFGREKPLHQVLGAGKPADILLWRNKKLSGGVLGGVTSLWFLFEMLDYHLITLICHLMILALSVLFLWSNASNFINNSPPTIPEVVIPEKWSP

SEQ ID NO: 222 - protein, 319 aa, Gossypium hirsutum
QRKKGETKIMEHDDMFMGNRSQTGNKYNPNNATTNSFNFETTLTESHALNHPHQQQQRYSLYAGDGSSRIHQSADPHLVCLKLGKRHYFEGSTDLNNNRHSAGGFSIGKKGKPYYDNLSGEGGGPSSSTGPRCQVEGCNVTLVNAKDYHRRHKVCETHSKAPKVVVLGLEQRFCQQCSRFHLVSEFDDSKRSCRRRLAGHNERRRKTSQDSATRNFAHDNKPMTGSFPYVSSPTGRALSLLSSKVDSWISPSNLSTRSSAALRELIVENRAAVLARQLVLERDWHYIGEPQPAGSNPILVQHHSMLDPHRWDFPFPEIG

SEQ ID NO: 223 - protein, 306 aa, Gossypium hirsutum
KSISFTNPTVPLYPRLAQGKSWNEMTVTWTSGYDIDEAVPFVEWGRKGDLQVRSPAGTLTFKQNSMCGSPASTVGWRDPGFIHTSFLKDLWPNFVYMYRIGHLLYNGSNEYSDYQPGSLNTTDQLIRDLDNIDIVFHIGDLTYSNGYISQWDQFTAQVEPIASTVPYMIASGNHERDWPNSGSFYDTPDSGGECGVPAETMFYYPAENKAKFWYSTDYGLFHFCIADSEHDWREGSEQYGFIEQCLASVDRHRQPWLIFSAHRVLGYSSNDWYSQEGAYEEPMGRDGLQKLWQKYKVVHCLLRPCP

SEQ ID NO: 224 - protein, 245 aa, Gossypium hirsutum
AEAAAAAGESSFKSFMVAVQRAGSSVAIVQQYFANSISRLLLPVDGSHAAACEEMATAMSSAEGAAFKGLHQCIETVMAEVDRLLSAEQKAADYHSPDDGMVHDHRPTNACTRVVAYLSRVLETAFTTLEGLNKQAFLTELGNYLYKGLVNHWQKFTFNPSGGLRLKRDITEYGEFVRSFNAPTVDEKFELLGILANVFIVAPESLSSLFDGTPSIRKDAQRFIQLRDDYKSAKLASRLSSLWSS

SEQ ID NO: 225 - protein, 345 aa, Gossypium hirsutum
MAAALQLQTHPCFHGTCQLSPPPRPSVSFPSSSRSFPSSRRSLSAHVKAAASSLSTTTLQEGIAEFYDESSGIWEDIWGDHMHHGYYDPGSDVSGSDHRAAQIRMVEESLRFAGISEDPANRPKRIVDVGCGIGGSSRYLARKYGAKCQGITLSPVQAGRANALANAQGLADQVCFEVADALNQPFPDDQFDLVWSMESGEHMPDKPKFVKELVRVAAPGGTIIVVTWCHRDLGPSEESLQPWEQKLLNRICDAYYLPEWCSTSDYVKLFQSLSLQDIKAGDWTENVAPFWPAVIRSALTWKGFTSLLRSGLKTIKGALVMPLMIEGFQKGVIKFAIIACRKPAE

SEQ ID NO: 226 - protein, 208 aa, Brassica napus
HDGVVRTLAEHKLLPRIIAGSSVGSIICSVVASRSWPELQSFFENSLHSLQFFDQLGSVFTIVKRVMTQGALHDIRQLQCMLRNLTCNLTFQEAYDLTGRILGITVCSPRKHEPPRCLNYLTSPHVVIWSAVTASCAFPGLFEAQELMAKDRSGEIVPYHPPFNLEPEEGGDKSSTRRWRDGSLEVDLPMMQLKELFNVNHFIVSQAN

SEQ ID NO: 227 - protein, 797 aa, Ricinus communis
MDISNEASVDPFSIGPSTIIGRTIAFRVLFCKSFAHLRRQIYHVLVYYIYRFRDVSASMLSWLHPRNPQGILAMVTIIAFLLKRYTNVKLRAEMAYRRKFWRNMMRTALTYEEWAHAAKMLDKETPKMNECDLYDEELVRNKLQELRHRRQEGSLRDIIFCMRADLIRNLGNMCNPALHKGRLQVPKLIKEYIDEVSTQLRMVCDSDSEELSLEERLAFMHETRHAFGRTALLLSGGASLGAFHVGVVKTLVEHKLLPRIVAGSSVGSIVCSIVATKSWPELQSFFEDSLHSLQFFDQIGGLFTVVKRVATQGAVHDIRQLQWMLRHLTSNLTFQEAYDMTGRILGITVCSPRKHEPPRCLNYLTSPHVVIWSAVTASCAFPGLFEAQELMAKDRSGEIVPYHPPFNLDPEEGSGESARRWRDGSLEIDLPMMQLKELFNVNHFIVSQANPHIAPLLRMKEFVRAYGGNFAAKLAHLTEMEVKHRCNQVLELGFPLGGLAKLFAQEWEGDVTVVMPATVSQYLKIIQNPTHMELQKAANQGRRCTWEKLSAIKANCGIELCLDECVAILNHMRRLKRSAERAAAASHGLTSTVASTVKFSASRRIPSWNCIARENSTGSLEEDLLADVASTFHQGVGGSGAAGTTGRNMRTHRYVHDGSDSESENADLNSWTRSGGPLMRTTSANKFIDFVQNLDVDTELARGLMRDCSNRPSLNSSSITVAEGDLLQPERTHNGFVLNVVKKENLAISKRTPDLENYNSEVPECVQLDCPDRDMDASSASDYAGDDDDDDNDDDVT

SEQ ID NO: 228 - protein, 383 aa, Populus tremula x Populus alba
LAHLAEMEVKHRCNQVLELGFPLGGLAKLFAQEWEGDVTVVMPATLAQYSKIIQNPNHLELQKASNQGRRCTWEKLSAIKANCGIELALDECVSVLNHMRRLKRSAERAAAASHGQASSASTLRFSASKRIPSWNCIARENSTGSLEEDFLADVASTFHQGVGVAGGTSTGRNLRTQRNLHHDGSDSESESVDLNSWTRSGGPLMRTASANKFIDFVQSLDVDSELRKGFMAHPNSPGAQMGGRDPYNQISRVTTPDRNSESEFDQRDFSNRNSTGGSSITVTEGDFLQPERIHNGFVLNIVKKEDLAHPNRIHDLENYNSEVPECVQLDCPEKDMDASSESDYAAEEDDSPATDSLHKSASTLDHTDDSVVHDIQEKHVVDG

SEQ ID NO: 229 - protein, 204 aa, Hordeum vulgare
PYISPLLRMKEIVRAYGGRFAGKLARLAEMEVKYRCNQVLEIGLPLGGLAKLFAQDWEGDVTMVMPATVAQYLKIIQNPTYPELQMAANQGRRCTWEKLSAIRANCAIELALDESIAALNHKRRLRRSIGRAAASSQGYTDNVRPKTPRRVPSWSCISRENSSGSLSEDHFAAAISSSHQGTIRVDAAPSTSHHVRKSSVDGSE

SEQ ID NO: 230 - protein, 204 aa, Brassica napus
  misc_feature (76)..(76): Xaa can be any naturally occurring amino acid
  misc_feature (78)..(78): Xaa can be any naturally occurring amino acid
  misc_feature (107)..(107): Xaa can be any naturally occurring amino acid
  misc_feature (162)..(162): Xaa can be any naturally occurring amino acid
  misc_feature (178)..(178): Xaa can be any naturally occurring amino acid
  misc_feature (181)..(181): Xaa can be any naturally occurring amino acid
  misc_feature (183)..(183): Xaa can be any naturally occurring amino acid
  misc_feature (186)..(186): Xaa can be any naturally occurring amino acid
MGKEDNQGEEYLFKIVLIGDSAVGKSNLLSRFSRDEFDTNSKATIGVEFQTQLVEIEGKEVKAQIWDTAGQERFRXVXSAYYRGAFGALIVYDITRSSTFESVKRWXQELNTHCDTAVAQMLVGNKCDLEDIRAVSVEEGKALAEEEGLFFMETSALDATNXDKAFEIVIREIFSNVXPQXLXSDXYKAQLSVNRVSLVNNSVG

SEQ ID NO: 231 - protein, 210 aa, Solanum lycopersicum
MEEEQEYLFKIVVIGDSAVGKSNLLSRFARDEFDHNSKATIGVEFQTQVVEVDGKEIKAQVWDTAGQERFRAVTSAYYRGAVGALIVYDISRSTTFENIKRWLDELNTHCDTTVARMLVGNKCDLENIRDVSVEDGKNLAEEEGLFFIETSALDSTNVKTAFEIVIREIYKNVSRKVLNSDSYKAELSVNRVSLANGTDMSKQKTSCCSS

SEQ ID NO: 232 - protein, 218 aa, Ricinus communis
MGQDQGGGGGEEYLFKIVLIGDSAVGKSNLLARFARNEFDSNSKATIGVEFQTQVVDIEGKEIKAQIWDTAGQERFRAVTSAYYRGAVGALIVYDITRRSSFDSVKRWLEELSTHCDTTAARMLVGNKCDLENIREVSREEGKTLAEEESLFFMETSALDSTNVEAAFEVVIREIYHNMSRKTLNSDSYKAELTVNRVSLVKNNANSSKQSSFSCCAT

SEQ ID NO: 233 - protein, 218 aa, Populus tremula x Populus alba
MGREQEEGEGGEEYLFKIVVIGDSAVGKSNLLSRFARNEFDSNSKATIGVEFQTQVVDIDGKEIKAQIWDTAGQERFRAVTSAYYRGAVGALIVYDITRRTSFDSVKRWLDELGTHCDTAIARMLVGNKCDLDSIREVSRDEGKSLAEEESLFFMETSALDSTNVEAAFEVVIREIYNNMSRKILNSDSYKAELTANRVSLVNGDTSSKKYGFSCCNT

SEQ ID NO: 234 - protein, 213 aa, Solanum lycopersicum
MDLISNLFYGLPLLYILYLIWKIIDRERHQNCYILDYECHKPTDDRMLSTKFSGEIIMRNKHLGLNEYKFLLKAVVSSGIGEQTYAPRMVFDGREACPTYEDGILEMEEFFHDSIDKLFKRNKISPSQIDVLVVNISMLASMPSMAARIINYYKMREDIKVYNLTGMGCSASLISLNIVENIFKNEKNKVALLVTSKSLSPNWYVGNDKSMIL

SEQ ID NO: 235 - protein, 471 aa, Ricinus communis
MDLLMLLYGFLILYSLFLLFKRAGGRRDQECYILDYECYKPTDDRKLDTNFCGELITRNKNLGLNEYKFLLKAIVSSGIGEQTYAPRMVFDGREENPTFEDGILEMEEFFHDSIEKLLSRSGISPQEIDVLIVNVSMLSVAPSLSSRIINRYKMREDIRSFNLTGMGCSASLISVNIAQNIFKSHKNVCALVVTSESLTPNWYSGNDRSMILANCLFRSGGCAMLLTNKRALEHKAMFKLKCLVRTHHGGRDESYECCLQKEDDQGRPGFHLGKSLPKAATRAFVDNLREISPKILPIRELLRFSIMTFIRKWSQSRNSGKGGGATTPAPRPVINMRTGVDHFCIHTGGKAVIDGIGVNLDLSEYDLEPARMTLHRFGNTSASSLWYVLAYMEAKKRLKKGDRILMISFGAGFKCNSCVWEVVRDLENSNVWKDCIDSYPPKTLANPFMEKYGWIYNEDESTFVLPQFEKN

SEQ ID NO: 236 - protein, 288 aa, Populus tremula x Populus alba
MDVPMLVYAFLIFYPLFMLWRRIDRKRDRECYILDYECHKPTDDRKLDTECSGQVIRRNKNLGLNEYKFLLRAIVSSGIGEQTYGPRIIFNGQEENPTLQDLISEMEEFFHDSIGKLLARSGIAPKEIDVLVVNVSMQSVVPSLPAMIINHYKLREDVKVFNLTGMGCSASLISVNIVQNIFKTYKNAYALVVTSESLSPNWYAGSDRSMILANCLFRSGGCAMLLTNKRALKHRAMLKLKCLVRTHHGAIDESYDCCHQREDDQGRSGFHLDKSLPKVATRALVDNL

SEQ ID NO: 237 - protein, 227 aa, Populus tremula x Populus alba
LSLSLSLSLSHTHTHTHTHTHSTMDFLLLVYAFLIFYPLLVLWRGIDRKRDRECYILDYECYKPTDDRKLDTEFSGKVIMRSKQLGLNEYKFLLKAIVSSGIGEQTYGPRIMFKGQEENPTLQDSVSEVEEFFHDSIEKLLARSGISPREIDVLVVNVSMLSSVPSLAARIINHYKLREDVKVFNLSGMGCSASLISVDIVQNVFKSCKNVYALVVTSESLSPNWYS

SEQ ID NO: 238 - protein, 210 aa, Hordeum vulgare
RQRDDAHAAAVHCEDADGRLGVSLSKALPKAAVRAFSENLQRLAPRILPAAELARFTVRLLARKLMRRKLKFEGPKINFKTGVDHFCLHPGGTAVIEAVRKNLGLNSYDVEPAAMTLHRWGNTSASSLWYVLSYMEAKRRLKAGDRVLMVTFGSGFKCNSCYWEVSKDLDDAGAWEDCIDDYPPETMVNPYTEKFGWVNDLQCQGGAFPF

SEQ ID NO: 239 - protein, 787 aa, Ricinus communis
MAPSLSKANSGPEGLVVESYDINHSNQFVISLEDSNLKANGHVFLSCVPDNITLTPSRYALTDKSSTTVGSFIGFDSMESKDRHVISIGKLKNIKFMSIFRFKVWWTTHWVGSNGRDLENETQMLILDKSDSGRPYILLLPLLEGPFRASLQPGNDDNIDICVESGSTKVLAAGFQSVLYVHIGDDPYKLVKDAMKIVKVHLGTFKLLEEKNPPGIVDKFGWCTWDAFYLTVHPQGIWEGVKGLVDGGCPPGLVLIDDGWQSISHDEDPITKEGMNAAVAGEQMPCRLLKFQENYKFRDYVSPKSLANGSTENKGMGAFIKDLKEEFSSVDYVYVWHALCGYWGGLRPNVPGLPDTVVVKPKLSPGLELTMEDLAVDKIVSTGVGLVPPETVEQMYEGLHSHLQNVGIDGVKVDVIHLLEMLCENYGGRVDLAKAYYKALTASVRKHFNGNGVIASMEHCNDFMFLGTEAICLGRVGDDFWCTDPSGDPNGTFWLQGCHMVHCAYNSLWMGNFIHPDWDMFQSTHPCAEFHAASRAISGGPIYVSDSVGKHNFPLLKRLVLPDGSILRCQYYALPTRDCLFEDPLHDGKTMLKIWNLNRFTGVIGVFNCQGGGWCRETRRNKCASQFSHLVTAKTNAKDIEWKNGTNPNSIEGVQVFAMYLFKAKKLLLSKPYENIEIALEPFNFELITVSPVVTLSEKSIQFAPIGLVNMLNTGGAMQSLSYNADSSIEIGVRGEGEMRVFASEKPRACRIDGKEVEFEYEECMVVVEVPWSTTNSSGVSNVEYLF

SEQ ID NO: 240 - protein, 256 aa, Populus tremula x Populus alba
AASRAISGGPIYVSDAVGKHNFPLLKRLVLPDGSILRCEYHALPTRDCLFEDPLHDGNTMLKIWNLNKFTGVVGAFNCQGGGWCRETRRNQCASQFSHLVTAKTNPRDIEWSSGKNPVSIEGVQMFAMYLSQSKKLVLSKPDENIEIALEPFNFELITVSPVTILAGKSVHFAPIGLVNMLNTGGAIQSLAYTDDAKSTVQIGIKGSGEMRVFASEKPRACKIDGREVAFEYEEHMITTQVPWSSLSGLSIVEYLF

SEQ ID NO: 241 - protein, 225 aa, Sorghum bicolor
IRKSPSFSTRQTNQTLINQRNSLEHSRSPTSAIAMAPNLSKTTPAAGLPLGDEVAPVEGLKPSRFTLKGKDLAVDGHPFLLDVPANIRLTPASTLVPAAPAPAGNGSFLGFDAAEAKSRHVVPVGRLRDIRFMSIFRFKVWWTTHWVGDNGRDVENETQMMVLDRSAAAGEPGSGRPYVLLLPIIEGSFRACLEAGKVDDYVDLCVESGSSSVRGAAFRSALYLH

SEQ ID NO: 242 - protein, 271 aa, Brassica napus
  misc_feature (2)..(3): Xaa can be any naturally occurring amino acid
  misc_feature (7)..(7): Xaa can be any naturally occurring amino acid
  misc_feature (89)..(89): Xaa can be any naturally occurring amino acid
MXXSIFXSLALASLLVGVVSARDWNILNQLKGLSSSSSQNGIVSSGVSTNLKRYCESWRINVEVHNVRNFDVVPQECVSHVKKYMTSSXYEDDVERAVDEVILHFGSMCCTKTKCDGMDAWIFDIDDTLLSTIPYHEKNGFFGGEKLNSTKFEDWMRKRKAPPVPHMVKLYHDIRERGIKIFLVSSRKEYLRSATVDNLIQAGYYGWSNLILRGIEDEHKEVKQYMSEKRTWLMGLGYRVWGVMGSQWSSFAGCPLPKRTFKLPNSIYYVA

SEQ ID NO: 243 - protein, 272 aa, Ricinus communis
MARNLVFILALTSLCISLVAADWNILNQKRRNGFKSESTSGLKNYCESWRINVELNNIREFKVVPQECIAYIKHYMTSSQYEADSERAIEEVKLYLSTCCHLQSDGKDAWIFDVDDTLLSTIPYYKKHGFGGEKLNTSLLEEWMKESKAPALEHTLKLFHVIKDKGVKIFLVSSRSETLRSATVDNLINVGYHGWSSLILRGLEDEFTNLQEYKSKARKRLMDEGYRIWGIIGDQWSSIKGLPSAKRTFKLPNSIIPSPPSPPPPPPPPRTK

SEQ ID NO: 244 - protein, 255 aa, Populus tremula x Populus alba
MARNLVFILALTSLYIGLAAADWNILNKKSKSRDASSLKNYCESWRINVELNNIKDFEVVPQECVDHVKHYMTSSQYTADSERAIEEVRLYLSSCCTLEGDGKDAWIFDVDDTLLSTIPYYKKHGFGGEKLNATLFESWMKQGKAPALDHTLKFFHEIKGKGVKIFLISSRSETLRSATVENLINAGYHGWSSLILRGLEDDFMKVQQYKSEARRALTKEGYRIWGIIGDQWSSVEGLPGAKRTFKLPNSMYYLS

SEQ ID NO: 245 - protein, 188 aa, Solanum lycopersicum
MMKTLLVSLFLISSVTTSSSSSASDIVRSSCVHASYPTICVRTLSSYSDTPINTPQDLAQAAVKITLSRAGKASGFLSRVKVESKREKGALSDCIEQMGDSMEELRKSLSELKHVRRGNAFKWQMSNLETWVSAALTNEDTCLDGFKEIDGKIRSDVKRKITNVARVTSNALYLINRLDDSANKITHP

SEQ ID NO: 246 - protein, 252 aa, Ricinus communis
MHIRPSWPLLSGRRVQSLLGLSNLKKDNLIGQDSRVLCLRQSMQELVSLVPAHSNSSTQTEHWGMPPLFSLFILFLSLCSAAAKTHSAGAAPQDLVHSSCLHASYPNLCMRTLSSYSGPANTPHDLALAAVEVSLGRASKVSKYLSSLSSGLKTRKERVALSDCVEQISDSVDELSNTLNELKHLRGETFRWQMNNAQTWVSAALTNEETCLDGFEQVQRKVKCDVKRKITNVARVTSNALYMINRLGESRG

SEQ ID NO: 247 - protein, 196 aa, Solanum lycopersicum
MEDDVEMAAGENGAGELDDMKKRLKEMEDEAVALREMQAKVEKEMGSVQDPAAAAANQANKEEVDSRSVFVGNVDYSCTPEEVQQHFQACGMVNRVTIRTNKFGQPKGYAYVEFVESEAVQEALLLNESELHGRQLKVSAKRTNVPGMKPYRARRPNLYMGFRGRAPFMPAPYFFPPFGYGKIPRARAPMRYSPYF

SEQ ID NO: 248 - protein, 198 aa, Ricinus communis
MEGEDMVMDGTEINEEEVPELDDMKKRLKEMEDEAAALREMQAKVEKEMGSSQDPTAAASQANREEVDSRSVFVGNVDYSCTPEEVQQHFQSCGTVNRITIRTDKYGQPKGYAYVEFLEPEAVQEALLLNESELHGRQLKVTAKRTNVPGMKQFRPRRPNPYMGFAPRGSQLPPYFYSPYGYGKVPRFRMPMRYSPYN

SEQ ID NO: 249 - protein, 228 aa, Populus tremula x Populus alba
IGSVNYILASRIVCRSHSSPRELEKEGGRMDGDDVDMAAAETNESVPELDDMKKRLKEMEDEAAALLEMQAKVEKEMGSVQDPSASAAASQANREEVDSRSVFVGNVDYSCTPEEVQQHFQACGTINRVTIRSDKYGQPKGYAYVEFLEPEAVQEALLLNESELHGRQLKVTVKRTNLPGMKQFRARRPNPYMGFPPRGAPMPPYLFSPYGYGKVLRYRMPMRYSPYG

SEQ ID NO: 250 - protein, 199 aa, Populus tremula x Populus alba
MDGDDVDMAAVETAEAVPELDDMKKRLKEMEDEAAALREMQAKVEKEMGSVQDPSASATASQANKEEVDSRSVFVGNVDYACTPEEVQQHFQACGTVNRVTIRSDKYGQPKGYAYVEFVEPEAVQEALLLNESELHGRQLKVTAKRTNVPGMKQFRARRPNPYMGFPPRGAIMPPYLFSPYGYGKVMRYRMPMRYSPYG

SEQ ID NO: 251 - protein, 156 aa, Solanum lycopersicum
MAGSEFPHAYPQTPSIDTSETLFQRRSRCFCFPSFRSPNQLTKYVKFDWWHRLRSGAVKEGSVWAKGINALKKLREWSEIVAGPRWKTFIRRFHRNKSGNRNAKFQYDPLSYSLNFDEGRGNNGEEEEELVLRNFSTRYASIPASSNLGKDGPSFV

SEQ ID NO: 252 - protein, 181 aa, Ricinus communis
RLTVVNRMGVEDPEAVSVSVGDQSSNSLLMNSRCCFCFPCLGSRGSSTVGLAWWERIRSSKGHPSEEDNKPKWWSKGVRALKKIREWSEIVAGPKWKTFIRRFNRCNRGSGNGRHNGKFQYDPLSYALNFDEGQNGHFHDEENDDYGGFRDFSSRYASVSASGKPLSMDVSSRDKEMAVNA

SEQ ID NO: 253 - protein, 185 aa, Populus tremula x Populus alba
RERERRERTGSIQMAFKGAEPIPEETTSNSLLTNTRCCFCFPCFSSRRSSTVGLSFWERIQSSSQSHGYDPHQNQWWFKGIRALKKIREWSEIVAGPKWKTFIRRFNRSKSSGSGNGRRHGNFQYDPLSYSLNFDEGPGGQKGDFDELDDYGGFRDFSSRYASVSASGQPVAMDASESKDVVVMA

SEQ ID NO: 254 - protein, 175 aa, Populus tremula x Populus alba
SIEMAFREVEPIPEETTSNSLLTNTRCGFLFPCFSSRRSSSVGLSFWERIKSSPSSNGDDPHPNQWWSKGMRAFKKIREWSEVVAGPKWKTFIRRFNRNKNSGSGNGRHHGKFQYDPFSYSLNFDEGPGGQNGNLDDLDDYNGFRDFSSRYASVSASGRPVAVDASKSKDVAVMV

SEQ ID NO: 255 - protein, 217 aa, Brassica napus
  misc_feature (37)..(37): Xaa can be any naturally occurring amino acid
MGNQKLKWTEEEEEALLAGVRKHGPGKWKNILRDPEXAGQLSNRSNIDLKDKWRNLSVAPDIQGSKDKVRTPKIKAAAFQLAAVAAASTPSPSSNHSPVPPLPRSGSDLSIDDSCNFMVDAKNAPRYDGMIFEALSSLTDANGSDVTAIYNFIVQKGHEVPPNFKRILGSRLRRLASQGKLEKVSQLKSGTQNFYKMNNHSFMAMRTPLVARPKEVN

SEQ ID NO: 256 - protein, 200 aa, Brassica oleracea
DKVRTPKIKAAAFQLAAVAAAATTPSPSSVSSPVAPPLPRSGSSDLSIGDSCNMLIDAKNAPRYDGMIFEALSALKDANGSDVTTIFNFIEQKMYEVPEKRVLGSRLRRLAAQGKLEKTQNLYRMNNNSFLTMRTPVPAARPKEANAKPRNSQGLTVSQEKIALASGTAAFKLYELDGKLEVLGGAVDDRARMTELAERA

SEQ ID NO: 257 - protein, 335 aa, Solanum lycopersicum
  misc_feature (322)..(322): Xaa can be any naturally occurring amino acid
MGNPKVKWTSEEEDALKAGVTKHGSGRWKNIIRDPEFAPILINRSNIDLKDKWRNMCIYTAGQGSKDKSIVVRTRPMEIDAFVPSPIQSLPPITSAFENEAIEDSPDVQPEGVNAPKYNDMIFEALSSMGDSNGSDLGAIVGFIEQRHEVQPNFRRTLSSKLRRLVAQGKLEKVQKCYKMKDATSETNISTPQQNDVRSWPVPNSVPRQSDVLSWPVPSSAPKQNDVLSWPVLNSAPKQNDVRSRPVPNMASKQNDVRSWQVPTSGVKVSSGTAEEAARIAADIVADAENKRCLEVAAVRDAEMKLRMVDDAESMLQIIKEXYEHCLQGEIIFLA

SEQ ID NO: 258 - protein, 271 aa, Ricinus communis
MGNQKQKWTAEEEEALLNGVAKHGPGKWKNILKDPDFAPFLTQRSNIDLKDKWRNLSVSNAAQGSNPKTRGAPKPKILPLPPPSNANAQITATADALMDDCLNNAADGKNAPRYNAMIFEALSTLKDINGCDISAIVHFIEQRHEVPQNFRRLLGSRLRRLVSQGKLEKVQNGYRISKDAALGAKTPTPRQKDVRPRQSQNSGLTSGETVEEAAIAAAYKVAEAENKSFLAAEAVKEAERVSKMAEDTDSMLQLVKDIYEQCSRGEIVLLA

SEQ ID NO: 259 - DNA, 951 bp, Malus x domestica
tcgaattccgttgctgtcgagatagccgagtcgtcatcggaggatatcccctttccctacatcttctcctccttcttcgtcgccaacagagaaccgaacagcaacaaaaatggccaacgcagcatctggtatggctgtgcacgatgattgcaaactgaagtttttggagcttaaggcaaagcggacctaccgctccatagttttcaagattgaggagaagcaaaagcaagttgtggtggaacatgttggtgaaccagcagaaacctatgagcagttcactgagaagcttcctgctgatgaatgccgttatgctatttttgattttgactttcttacacctgaaggtgtccagaaaagccggatattcttcattgcctggtctcctgacacatcaagggtgagaagcaagatgatatacgcaagctccaaagacagattcaagagagagctcgatggaattcaggttgagttgcaagcgactgatccaactgagattggtctcgatgtcattaagagccgagccagctagattatgaatcataggctatctggtggggagttcgtccctgcaccctttgttacttgcgtgatatgtttatacattgtggaaatggcgacttggcgaaagatggaatcaatttccaagttttgccgttgtttcttatttattttaaacaagcgtctgtggtttctggtatatcatatgatatgtttatttgatagaacctatctttgttgagtggctgctttagtagctgtatgtcaacaaactaatatgtagctgtttgtggggtttagacggcacctttccgccttccgagtgttgtatatgacccttgtcattttactttggagcagtataaaaggagcatgcttttatggccttttttttttaaaaattgattaaaattttccaataaaataaccaaaccagccctaattttgttggtc

SEQ ID NO: 260 - DNA, 685 bp, Malus x domestica
tcgaattccgttgctgtcgagatagccgagtcgtcatcggaggatatcccctttccctacatcttctcctccttcttcgtcgccaacagagaaccgaacagcaacaaaaatggccaacgcagcatctggtatggctgtgcacgatgattgcaaactgaagtttttggagcttaaggcaaagcggacctaccgctccatagttttcaagattgaggagaagcaaaagcaagttgtggtggaacatgttggtgaaccagcagaaacctatgagcagttcactgagaagcttcctgctgatgaatgccgttatgctatttttgattttgactttcttacacctgaaggtgtccagaaaagccggatattcttcattgcctggtctcctgacacatcaagggtgagaagcaagatgatatacgcaagctccaaagacagattcaagagagagctcgatggaattcaggttgagttgcaagcgactgatccaactgagattggtctcgaagtcatttggagccgagccattaaaattgatatcgaaatcgtcatttatttaaggcgaacatacgttaataggcaactttagtccttgaattaataccaatttatactgactgatccactgtaatgcttaatctgaatcccccatcttttagtataaatatatcatcgaattaaaattact

SEQ ID NO: 261 - DNA, 1022 bp, Malus x domestica
atttcactttccacattccctccttgcagacaggagtcttccacaggtctgacgcgcctccgaaaagccgaaaataataacggagattgcagagagcaaaagcaaatcaccgggagagatctgaagaacgagatcaccaccttcttcccagaagccaaaaagcttcagactttttctttggggtcacagtaatggctgggtacagagctgaggacgactacgactacctcttcaagttggtgctgatcggcgactccggcgtcggcaagtccaacttgctgtcgaggttcaccagaaacgagttcagcctcgagtccaagtccacaatcggagtcgagttcgccacccgcagcttggatgtcgacggcaaagtcatcaaggcccagatttgggacactgctggccaagaaaggtaccgagcgataacaagtgcttactatcgaggggctgttggtgcactacttgtgtacgatgtcactcggaattcaacatttgaaagtgtggaaaggtggttaaaggagttaagagaccatactgatcccaacattgttgtcatgcttgttggtaacaaatcagatcttcgtcaccttgtggcggtctcaactgaggacggaaaatcctttgccgagagggagtctctctacttcatggaaacctctgcactcgaagcgaccaacgtggacaatgcattttctgaagtcctcacccagatctttcgcattgtgagcaggaaggccatggaggctggcgatggagctgcttcgaccgttcctcaaggagagaaaatcgatgtcagtaaagatgtttcagctgtgaagaaagctggatgttgctcaagctagggtccgaatctgcaccagatgtagctggtttctgttaccacatatctgttattccctctaccggggttgtgtaaaaaaaattctcggaaattctgccggcgttaggagataggcaggcggggttccgtgtttacttccattgtcgttatcattaattatcctaagacagatatgtttagc

SEQ ID NO: 262 - DNA, 1177 bp, Malus x domestica
  misc_feature (11)..(11): n is a, c, g, or t
aattcggcacngaggaacaactgaaagaaaagaaaagaaaaacaaacactggaaggaagagctggagtgacgcagaagaaatcaagcgacctataatttagtgttcttgtgcgcaaagcatttgcacgaacgaaacgatctctctctccctctcttttcagttgtctgtgaaagcaattggatttcgattctgatttttgagaaaccctaattctccgatgtcgatcttcgagtacaatgggagtgcactggtcgcaatggtggggaagaactgcttcgccatcgccagcgatcgccgcctcggtgttcagctccagaccgtcgccaccgacttcaagaggattagccaagtccatgataggctcttcatcggcctctccggcctcgccacggacgctcagactctgtatcagaggctcatgtttcggcacaagctgtaccagcttcgtgaggagagggatatgaagcccgagacttttgcgagcctcgtttcggctattctgtatgagaaaaggtttggtccctacttcactcagcctgtaattgctgggttaggtgatgaagacaaacccttcatctgtactatggattcaattggagccaaggaactagcaaaagactttgttgttgctggtactgcatccgagtccctttatggtgcttgtgaggcaatgttcaagcctgatatggaaccagaggaattgtttgagactgtctctcaagcattgctttcatcagtagatcgagactgtctgagtggttggggaggccacrtctttgtcgtaacaccaactgaagtgcaggagaagatcttgaagggaagratggactgacctygctrgcatgccttttwrtgartcctcctgrcrtttygttcaggctgcatcttttcctcrrgtgtttatgtagctttgacgtgaatkagsagacatwagctttcttggcgatcatmggccccttgttatgtttwgatttaatgtamtttgacgaktatakacagtgggatcatttgatttaaataggtcacttkragaaaatgyygggaattcaaatatgcttttcagttggtacgctcatgaatgtttctaaacagktttygawttatccwgatgtatttgctgtttctaaacattatcttgaatttattcacgttgcgcatttggaaacatttgatgct

SEQ ID NO: 263 - DNA, 860 bp, Malus x domestica
agccgagccgccatcggaggagagaccccctttccctatatcttctcctccttctccgtcgccatcagagaactaaacaggcagcaaaaatggccaacgcagcatctggtatggctgtgcacgatgattgcaaactgaagtttttggagcttaaggcaaagaggacctaccgctccatagttttcaagattgaggagaagcaaaagcaggttgtggtggaacatgttggtgaaccagcagaaacctatgagcagttcactgagaagcttcctgctgatgaatgccgatatgctatttttgattttgacttccttacaccagaaggtgtccagaaaagtcggatattcttcattgcctggtctcctgatacatcaagggtgagaagcaagatgatctacgcaagctccaaagacagattcaagagagagctcgatggcattcaggttgagttgcaagcgactgatcctactgagattggtcttgatgtcattaagagccgtgccagctagattatgaatcataggctatctggtgggaagttcttccctgcacccttcgttacttgcatgatatgtttatacattgtggaaatggcgacttggcgaatgatggaatcaatttccaagtttcgccgtcgtttcttatttgttttaaacaagtgtctggtttctggtatatcatatgatatgtttattttatagaacctatctctgttgagtggctgctttcggtagctgtatgtcgacaaactaatatgtagctgtttgtggggtttgacgacacctttcctctttgcgagtgttgtatatgacccttgtcatttttactttggagcagtttaaaaggagcatgcttttatg

SEQ ID NO: 264 - DNA, 707 bp, Malus x domestica
gaaaccaatcgacctataatttattcttgtgtagaaagcattcgcacgaacgaaacgatctatctctctcagtcgtcagtgaaagcaattggatttcgattcggtttattgaaagaccctaattctccgatgtcgatcaccgagtacaatgggagtgcactggtcgcaatggtggggaagaactgcttcgccatagccagcgatcgccgcctcggtgttcagctccagaccgtggccaccgacttcaagaggattagccaagtccacgataggctcttcatcggcctctccggccttgccaccgacgctcagactctgtatcagaggctcatgtttcggcacaagctgtaccagcttcgggaggagagggatatgaagccggagacttttgccagccttgtttccgctattctgtatgagaaaaggtttggtccctacttcactcagcctgtaattgctgggttaagtgatgaagacagaccattcatatgcactacggattcaattggagccaaggaactggcaaaagacttcgttgttgctggtactgcatcggagtccctttatggtgcttgtgaggcaatgttcaagcctgatatggaaccagaggaattgtttgagactgtctctcaagcattactttcatcagtagatcgagactgtctgagtggttggggaggccatgtctttgtcgtaacaccaactga

SEQ ID NO: 265 - DNA, 878 bp, Malus x domestica
agtaatggctgggtacagagctgaggatgactacgactaccttttcaaggtggtgctgatcggcgactccggcgttggcaagtccaacttgctgtcgaggttcaccaggaacgagttcagccttgagtctaagtccaccatcggcgtcgagttcgccacccgcagcttggatgtcgacggcaaagtcatcaaggctcagatttgggacactgccggccaagaaaggtaccgggcaataacaagtgcttactatcgaggggctgtgggtgcactgcttgtgtatgatgtcactcggaattcaacttttgaaagtgtggaaaggtggttaaaggagttaagagaccacactgatcccaacattgtcgtcatgcttgttggtaacaaatcagatcttcgtcatcttgtggcagtctcaactgaggatggaaaatcctttgccgagagggagtctctctacttcatggaaacttctgcactcgaagcgaccaacgtggataacgcattttctgaagtcctcactcagatctttcgagtcgtgagcaggaaggccatggagtctggcaatgaaggagctgcttcagctgttcctcaaggggagaaaatcgatgttggtaaagatgtttcagctgtgaagaaaggtgggtgttgctcaacctagagtccgaatctgcaccggatgtagctggtttgtgtttgccacatctgtttttccctataccggggttgtgtaaaaaaaattcttggaaattctgccggctttaggagataggaaggcggggttcggtgtttacttccattgtcattatcattaattaccctaagacagatatgtttagctgatcaagaggagcttgtttagtaacaagatattaaatgtt

SEQ ID NO: 266 - DNA, 2039 bp, Malus x domestica
ctgtcaccaccaccaccactgctcctcatctcttctcatctctctccttctctgccgaacacctagcagccaaccatgcctccaatcttgccggacttctccaactccgtcaagctcaagtatgtcaagctcggctaccagtacctcgtcaaccacattctcaccctcactctcatccccatcatggccggtatcctcctggaggtcctccgcctcagccccgatgagcttctcaagctctgggactccctccacttcgacctcgtccaaatcctatgctcctccttcctcatcatcttcatcgccaccgtctacttcatgtccaaaccccgccccatctaccttgtcgactacgcctgcttcaaacctccggtcatgtgccgcgttccgttctccaccttcatggagcattcccgcctcattctcagcaacaaccctaagagcgtcgagttccagatgaggatcctcgagcgctcgggcctcggcgaggagacttgcctccctcmggcaatccactacattccgcccaaccccaccatggaggccgcgaggggcgaggcggagctcgtcatcttctccgctatggactctctgttcgagaaaacggggctcaagcccaaagacatcgatattcttatcgtcaactgcagcctcttctcgccgacgccgtctctctcggcgatggtgatcaacaaatacaagctgaggagcaacatcaagagcttcaatctctccggcatgggctgcagcgccggcctcatctcaatcgatttggcgcgcgacctcctccaggtgcatcccaactccaacgcggttgtcgtcagcaccgagatcatcaccccgaactattaccaaggcaatgagagggcgatgctcctccccaactgcctcttccggatgggaggcgccgccttgcttttatcgaacaggaggtccgagcaccgccgcgccaagtaccgattggtccacgtagtccggacccacaagggagccgacgacaaggcgtataagtgcgtgttcgaagaagaggacaaggagggcaaagttggaatttcgctctctaaagatctgatggcaattgcgggggaagcgctgaaatcgaacatcacgacgatcgggccgctggtgctgccagcgtcggagcagttgctgtttctcatcacgctcatcgggcggaaaatcttgaacccgaaatggaagccctacattccagatttccgacaggcgttcgagcacttctgcatccacgcgggcgggagagcagtgatcgacgagctgcagaagaatttacagctgtcggcggagcactgcgaggcgtcgaggatgacgctgcataggttcggcaatacgtcgtcgtcatcgctgtggtacgagttggggtacatcgaggcgaagggtaggatgagaaaaggtgatagggtttggcagattgcgttcgggagcgggtttaagtgcaacagcgctgtttggaagtgcaatcgagccatcaaaacggcgtcagatggaccctgggctgattgcatcgataggtacccggttcatattcctgaagtggtgaagctttagggtttggaaacaagaacacgaatgaaatggtgaatggtgattggtggtgccttttctttgattaaaatcaaatatatattttaatcatatattacrtgacggtatgattgaaatctttctttatatcawaaaaaacagaatctattcatcagccgtcacaacatttagttttttaaatggtaatgttagggagacttaatttttaaatttggttttacgtttaatgtttcttacaacatctagtattctctttatgcaactctcgccttgtctatgtaccttgatttttttttgattcattcaatcataaacctaaaataaagtggacaaccagcgctgatatcggtgcaaaactaacacttgtacaaggtcccgtttgagtggaacaaacatacttctgtcgaaatcaattatacttgtcccgaccataaatgaaatgccttgaggcagatgatgatatctttccattcaaa

SEQ ID NO: 267 - DNA, 710 bp, Prunus armeniaca
catctctctctctctctctctctcggagccctagattttctcgccatttctctctacctcgacattttctcgggaaaatggcaaacgcagcgtctgggatggctgtgcatgatgaatgcaagctaaagtttttagaattgaaggcaaaaagaacttaccgcttcatagtttacaagatagaggagaagcaaaagcaggttatagtggaaaaggtgggtgaaccagctgatagctacgaggatttctctgcaagcctccctactgatgaatgccgatatgctgtctatgactttgattatgtgactgaggagaactgccagaagagccggattattttcattgcttggtcccctgacacatcgaaggtgagaagcaaaatgatctatgctagttcgaaggacaggtttaagagagagttggacggtattcaggtagagttgcaagccaccgatccaaccgaaatgggccttgatgttattagaagccgggcgacttgaatgttaagcatcagctctgcaactggagggggtcatctctatactatatggtttttatatgtcctgtttatagtctgtggacttgagtttggtttactattttattgcattgcctttgagaatgtgatttgtaattcgtggattattggttacctcattctggtgtggatataacttcttgcccagcttgcatatataaatatatattttatc

SEQ ID NO: 268 - DNA, 916 bp, Prunus armeniaca
ggcacgaggagagagagagagagagagagagagagagagagagagagagagagagagagagagagagagagagagagagagagagagagagagagagagagagagagagtatccatagcaaaagctcgaagcacagagcaacgtataaaaggagcagggagtccttcattgtctctgagagtcacagattttcagctcatttttcgttttggcctagattttctgcaacctccatggctaatgcagcgtcgggatttgctgtggatgatgactgcaagctgaagtttctggaattgaaggctaaaagaacgtaccgcttcatagtattcaagattgaggaggagcaaaagcaggtgattgtggagaaacttggcgagccagctgaaagctatgaaaactttactgcaagccttcccgctgatgaatgcagatatgctgtctatgattttgactttgtgactgaggagaattgtcagaaaagcaggattttcttcattgcatggtctcctgatacatcaagggtgagaagcaagatgatttatgcaagctccaaggacaggttcaagagagaactggatggtatacaagtagagctgcaggctactgatccgactgagattggtcttgatgttatcaaaagtcgtgccagctaagaagtctggcgtttatttatggcgatttttctcaacctctgttttacttttaagtgaaatgttaatagtttgtggtgctgtgaacctgactgaattataatacttggtttgttgttcaagttttaccttacagtcttaccttcgtctagaacaaattctgtgatctcagtttatataggaagatggcaggaacatatgcaatgagtgtctgagtttctcctaatagttatatctagatgctaagttatatcaaaaaaaaaaaa

SEQ ID NO: 269 - DNA, 1547 bp, Aquilegia formosa
agggctcacggaatcgctgtttctttctcacaaagatgagtatcctgaacatgagcaggcatctcttagacagctgtatcaagccaagatggaagaagtgcgtgctgaaagccagcaacaatctgagtcaactggaactattgggcgttctaaaggagcttcactgccatcttcacaccagcagatatctgttactgtagtaacagagtttgtacgctggaatgaagaagcaatttctagatgcaccttgttttcttcccagcctgctactctagcaaacactgttaaaacagtgttcacttgcttacttgaccaagttagccaatacataactgaagggcttgaacgtgccagggatagtctaaatgaagctgcagctttacgagaaaggtttgtgctgggcacaaaccttagtagaagggttgctgctgctgcagcttctgctgcagaagccgcagcagctgctggtgaaagtagtttcagatcattcatggtggccgtacaacgttgtgcgagcagtgtggctatagttcaacaatacttcacaaactctatctctcgtctcttactacctgtggatggtgcccatgctgcttcttgtgaagaaatggcgacagctatgtccagtgcagagggtgctgcttataaaggtcttcaacagtgcattgaaacggttatggctgaggtggagcggttgctttctgctgaacaaaaagcaactgattatcggtcacctgatgatggaattgctcctgatcatcgaccaacaagtgcatgcacaagagttgttgcatacctttcccgtgtacttgaggttgcattcactgctctggagggtctaaacaagcaagcattcctgactgaattgggaaaccgtttgcacaaggggctgcttagtcattggcagaagtacacattcaaccccagtggtgggctgcggctgaagcgtgacataacagaatatggggaatttgttcgcagttttaatgctccttcagttgatgagaaatttgaattgttgggaatcatggccaatgtcttcatagttgcacctgaaagccttaacaccttatttgagggaactccaagtatcaggaaagatgcacaaaggtttattcaacttcgagaggacttcaagtcagcaaaacttgcttccaaactcagctctctgtggtctagctagtttgtgttgatacagaagtgacaaggtgttgatcaggtataggaattgaaattacggaaacttcaaaaccttcaggtctccctagttggataccatccaagctcagttgatttgtcagtggcaaactgactaaaatccctgttttatgctaaattattttggaaggtttggcacagaatcatcttggatggagttggatcaattttttattttgtttcccagtgtacatatgtttgacgaacaaacgtatcctctcaaggagttttgtaattcagttcgtgtaagattgttagagattcaatcaccatgtgtgggtaatcgtagaaatttggaatacttgtatcattagaattagctcacttgt

SEQ ID NO: 270 - DNA, 1099 bp, Aquilegia formosa
ttaattaataaagttgaaaactttaaaaaccttcattacttcttcaacacatcttctctttctctttctctttctcttctaacaaaaaaaaacccacaaagaagaagagaaacagttgttgttgttgtttttgttgttaagtatggctgcatatagagctgatgatgattatgattacctttttaaagtagttttaattggagattcaggtgttgggaaatcaaatttattatcaagatttactaaaaatgaatttagtcttgaatctaaatctacaattggtgttgaatttgctactagaagtttaaatgttgatactaaagttattaaagctcagatttgggatactgctggacaagaaaggtaccgtgccattactagtgcttactacagaggagctgtaggagcactacttgtttatgacgtcactcgacatgcgacgtttgagaacacagagaggtggctgaaagaactaagggaccatactgaccccaacatcgtcgttatgctcattggaaacaagtctgacctccgtcatcttgtggcagtctcaactgaggatggaaaatcttttgcagagagggagtccctctacttcatggagacttctgcactagaagcaaccaatgtggaaaacgctttcgcagaagtcctgacccaaatctaccgtatagtaagcaagaagtcaatggagactggagatgacggagctgcagcaaacgtccccaccaaaggagaaaaactaaacgtcaaagatgacgtgtctgcactaaaacgagttggatgttgctcaagttagggtttgagatttcaaatatcacyttttaaggatgtaactttggtattttagctagctgcaactgttgtttctttgatgtacaccatatttttgtataagattctctcagggatttgtagcaggagttgaagcggagggaatagtccttcaaataacttctatttttttgtggtttagcagttgagatttttattagttgcacttagtgttaaacttgcaggggttttatgatgttgaagacgattattagctttcgatgttagtagtaggtacccaatgttgtaatctccatttatcaaa

SEQ ID NO: 271 - DNA, 1484 bp, Aquilegia formosa
gtgaatgagttcactgcggaacgggagcaacatgggacagttgatgatcagtgggtcaacgagttttccaaattacgtgttgacgattgggcggatgaattcgagcaccaggttggtgaaggagctttgggggacaactgggcttcttcttatgatgagtttctaaacgaacaagtagtcaagcaacgatcagatacttcaaggggtgtgtatgtcttttctgatgttaacccctatgttggtcatccaaatccgttgaaagaaggtcaggagctgtttcgcaaaggacttttgagcgaagctgtgcttgctttagaagctgaagtgttaaaaaaccctgacaactccgaaggttggaggttacttggaataacacatgcagaaaatgatgatgaccagcaggctatcgcatccatgatgcgtgcacaagaggttgatccaacaaatcttgaagttcttcttgctcttggcgtgagtcacactaacgaattggagcaggcagcagctttgaaatatttatacagctggcttcaacatcacccgaagtatggaacgcttgcccctccagagcaaattaattccctgtactatgctgatgtcgcaagattattcaatgaggccgctcagatatcgccagaagatgctgacgtccatatagtccttggtgtcctctacaacttatcaagagagtatgacaaagctatagcatcctttgagaccgcattgaaacttaagcctcgtgattattctctttggaacaaactcggtgcaacacaggcgaacagtgttcagagcgcagatgcaatattggcttatcaacaggcactggatttgaaacccaattatgttcgagcatgggcgaatatgggaatcagttacgccaaccagggtctgtatgaagattctattcgctactatgttcgagcacttgcaatgaatcccaaggcggataatgcctggcaatatttgagaatttctctcagctgtgcttctcgaaatgacatgatggaagcttgtgattcacggaatcttgatgttcttcagaaagaattccccctttgattttttttttgtctagggaatgattgatcatgacagtcatctcatattcaagcccataggggttcgggtgagggtcgaataagaacagacagaaatgccaggtaggattctctcattttctgaaggagtatgatgccacaaggaaccaaaataagtgcagtatcagctccttaaaagggtaaaaggatggagatcttaacaccagacaaataatcattgctcctgtgacaaataaccattctgggaagagaatgtatacattgtaaaacaactatatctgtcagtgactcgcagacgggcatctccacaatgtattatctatcttatggacagttttcctcctgttgtataaaagtaatgcttaagaaactctatatacatttatacaacttttggttggttttggacagcaaagataattt

SEQ ID NO: 272 - DNA, 918 bp, Arabidopsis thaliana
aagccaccgtcgactttacttagtactccctctctctcccctcctccttcccagatttcgtctccgttctgaaaaaaactccaaattctactctgaaaccctaagtttccgatgtcgatcttcgagtacaatggaagtgctgttgttgctatggtaggtaagaattgtttcgccatcgccagtgatcggagactcggtgttcagctacagacaatcgccactgatttccagagaatctccaagatccacgatcgtgtcttcatcggtctttctggtctcgccaccgatgttcaaacactataccagcgcttggtgtttcgtcataagctttaccagcttagggaagagagagacatgaagcctgaaactttcgctagtcttgtctcagccatcctttacgagaagagatttggtccttacttatgccaacctgtgattgctggcttgggagatgatgacaagcctttcatttgcacgatggactctatcggagccaaagagttagctaaagattttgttgtatctggaactgcttcagaatcactctatggagcttgtgaggcaatgtacaagccagatatggaagctgaggaattgttcgagacaatatcgcaagcacttctctcatctgttgaccgtgattgtctgagtggttggggagggcatgtttacattgtaacaccaacagagattaaggagaggatcctaaagggaaggatggattgatctgcttcttctattcaagttgttttccgctgtaatccggttttaagtagtgtaaccttcacatcccggtttaattatatgatcattccttggctgaaattatgggttatgtatgaagtttgattttcctcttggataatggattatatgattttaattcgtagagttatcgaagaataacacttttaactc

SEQ ID NO: 273 - DNA, 1059 bp, Arabidopsis thaliana
caagccatcgtcgactttaataattgttcttctcttgctcagatttcttctccgataggaaaactcccgaagcttcactcagtaaaccctaattttccgatgtcgatcttcgagtacaatggaagtgccgtcgtagctatggtagggaagaattgcttcgctatagctagtgatcggaggcttggtgtgcaattacaaaccattgctaccgattttcagagaatatctaagatccacgatcatctcttcatcggactttccggtctcgccaccgatgtccagacattgtaccagcgactcgtatttcgtcataagttatatcagcttagggaagaaagagacatgaagcctgaaactttcgctagtcttgtatcggctattctttatgagaaaagatttggcccattcttgtgccaacctgtgattgctggattgggagatgataacaaacccttcatttgcactatggattctattggagccaaggagttagctaaagattttgttgtctcgggaactgcttcagaatctctatatggtgcctgtgaagccatgttcaaaccagatatggaagctgaggaactattcgagacaatttcacaagcacttctctcttcagttgaccgcgattgtcttagtgggtggggaggacatgtctacgttgtaacaccaaaggaggtgaaggagagaatcctgaagggaaggatggattgatctgatatcacatatctgcttttgtccaagttcggtatactccttaacccggttatgtagaagctctcgtcccatagtaactatgttccttctctgaaactggatattgtggttcgttctctcggatgttttatttgctattgatagagttcaatgaaaatgaagaaatagcagttgttatcttgttccagtactcgatcattctatgtaccttgttgtttctgttttaatttcgtaccaagtgttccagatttctggtttgtcgcagtctttagttttcaaggttggtactgatcagtgacacgttttgttgtttgtcttcttagtgttcatgttcgattcact

SEQ ID NO: 274 - DNA, 896 bp, Arabidopsis thaliana
accactttaccacttatcaaagcttcttcaaagcttgcaaaaaattctccacagtctcgaagaagtagaagaagatgggtaaggaagatgaccgaggagaagagtacctgttcaagattgtcctaatcggcgattccgctgtcggaaaatcgaacttgctgtctcgattttcgcgggatgagttcgacacgaactcaaaagcgacaatcggagtggaatttcagacgcagctggttgaaatcgaagggaaagaagtgaaagctcagatctgggacactgctggtcaagagaggtttagagctgtcacttctgcttattacagaggtgcttttggtgctctcatcgtttatgacatcactcgaggtgacactttcgaaagcgttaaacgttggctccaggaactcaacactcattgtgacacggcagtggcacaaatgctagttgggaataaatgcgatttggaggatataagagcggtgagtgtggaggaagggaaagctcttgcggaggaagaaggattgttctttatggaaacatcggctctggacgccacaaatgtagacaaagcctttgagatcgttatcagagagatcttcaacaatgtcagccgcaaacttctcaactctgatgcttacaaagcagagctttccgttaaccgggtcagccttgtcaacaaccaagatggctccgagagctcttggcggaatccgtcttgttgctcccgatgatttcaatcaatcttgtttttaccagagaaagctttataaggttataattatcatttatgaagtcagacttataataagatacttgcaatctgttttgtcttgatactacacattggttctggccgagggattaaacaaaaatgacctgaccgaatagagaaaatggcg

SEQ ID NO: 275 - DNA, 909 bp, Arabidopsis thaliana
ataaacaaatgaaattcgtttcattcatataattcggatagcttgcaaataacgctgacaaaaaaagaaacagtgaagaagaaaaaaaagaaggtcattttcattttctccatttgatttttgccgaccggagaaaatatcttcttgccgtcttcttcttcatttcaccaggaacttttatttgaaatcggtttgatttagccatggcaaacgcggcatcgggaatggctgtgcatgatgattgcaagctgaaatttatggaactgaaggcgaaaagaacattccgtaccatagtctacaagattgaggataagcaagtgattgtagagaaactcggtgaacctgaacaatcatatgatgactttgcagctagtcttccagctgatgattgccgatattgcatttacgatttcgactttgtcactgcggagaactgccagaagagcaagatcttcttcattgcatggtctccggacactgccaaagtgagagacaagatgatttacgcgagctctaaagataggttcaagagagaactagatggaattcaagtggaacttcaagctactgatccaacagaaatgggtcttgatgttttcaaaagccgcaccaactaagtaaaacaaaaccctgtaagggcatttgaataagtttggtttctggagtgaatatgtttcctctgactgttatgaaaactttttaacaccttcaacttcattctacttggtattattgtatgtctttgatgtgttatgtgtgccttgtgatggttttcaattagttttacatgtacaatacttgaaatcagattgttgctaggcttcaagccttgtctcagttatctatctgataatttattcgtatatgtttggagtcctatatcaagcatctccttaaatggtttagatt

SEQ ID NO: 276 - DNA, 834 bp, Arabidopsis thaliana
gaagaaagaaagagaaaagaaattgagaagaaaaaaaaaaaaaggtgaccgtattctccgtcgattgtagccgcctgaagaaatatcttctcctctctcgttgaaccacgaatttgctctgatattagtgtttctctagccatggcgaacgcggcatctggaatggctgtgcatgatgattgcaagctgagatttctggaactgaaggcgaaaaggacacaccgtttcatagtttacaagattgaggagaagcagaagcaagttgttgttgagaaagttggtcaaccgatccaaacttacgaggagtttgcagcatgtcttccagctgatgaatgccgttacgccatttacgattttgactttgtcactgctgagaattgccagaagagcaagatcttcttcatcgcgtggtgcccggatattgctaaggtgagaagcaagatgatctacgcaagctctaaggacaggttcaagagggaactagatgggattcaagtagagctacaggcaactgatccaacagagatggatctcgatgttttcaggagccgtgccaactaaaaagtaaaaaccaaagtttattatcatcatccccttgaaagatctattctcttattctgttatttttgagtgatggtactggtacttgattatgtttttacattgtgttgtgaagttatgaacctataaacaacttcattctatcggtgtttcggtcttgtgttcgatgttgtctttggttttaaaatggtgtgtaaggaccccaaatcgtctattgaagatgaacccttttaggtatatcattgatgaaatggatgattaaaagtttctctc

SEQ ID NO: 277 - DNA, 877 bp, Arabidopsis thaliana
gaagaaagaaagagaaaagaaattgagaagaaaaaaaaaaaaaggtgaccgtattctccgtcgattgtagccgcctgaagaaatatcttctcctctctcgttgaaccacgaatttgctctgatattagtgtttctctagccatggcgaacgcggcatctggaatggctgtgcatgatgattgcaagctgagatttctggaactgaaggcgaaaaggacacaccgtttcatagtttacaagattgaggagaagcagaagcaagttgttgttgagaaagttggtcaaccgatccaaacttacgaggagtttgcagcatgtcttccagctgatgaatgccgttacgccatttacgattttgactttgtcactgctgagaattgccagaagagcaagatcttcttcatcgcgtggtgcccggatattgctaaggtgagaagcaagatgatctacgcaagctctaaggacaggttcaagagggaactagatgggattcaagtagagctacaggcaactgatccaacagagatggatctcgatgttttcaggagccgtgccaactaaaaagtaaaaaccaaagtttattatcatcatccccttgaaagatctattctcttattctgttatttttgagtgatggtactggtacttgattatgtttttacattgtgttgtgaagttatgaacctataaacaacttcattctatcggtgtttcggtcttgtgttcgatgttgtctttggttttaaaatggtgtgtaaggaccccaaatcgtctattgaagatgaacccttttaggtatatcattgatgaaatggatgattaaaagtttctctcacatttgtatgaaacaactgtctataggacaagattgatcttc

SEQ ID NO: 278 - DNA, 867 bp, Arabidopsis thaliana
gaagaaagaaagagaaaagaaattgagaagaaaaaaaaaaaaaggtgaccgtattctccgtcgattgtagccgcctgaagaaatatcttctcctctctcgttgaaccacgaatttgctctgatattagtgtttctctagccatggtaagctcaattttccacttgttatctcgatctgcgaacgcggcatctggaatggctgtgcatgatgattgcaagctgagatttctggaactgaaggcgaaaaggacacaccgtttcatagtttacaagattgaggagaagcagaagcaagttgttgttgagaaagttggtcaaccgatccaaacttacgaggagtttgcagcatgtcttccagctgatgaatgccgttacgccatttacgattttgactttgtcactgctgagaattgccagaagagcaagatcttcttcatcgcgtggtgcccggatattgctaaggtgagaagcaagatgatctacgcaagctctaaggacaggttcaagagggaactagatgggattcaagtagagctacaggcaactgatccaacagagatggatctcgatgttttcaggagccgtgccaactaaaaagtaaaaaccaaagtttattatcatcatccccttgaaagatctattctcttattctgttatttttgagtgatggtactggtacttgattatgtttttacattgtgttgtgaagttatgaacctataaacaacttcattctatcggtgtttcggtcttgtgttcgatgttgtctttggttttaaaatggtgtgtaaggaccccaaatcgtctattgaagatgaacccttttaggtatatcattgatgaaatggatgattaaaagtttctctc

SEQ ID NO: 279 - DNA, 910 bp, Arabidopsis thaliana
gaagaaagaaagagaaaagaaattgagaagaaaaaaaaaaaaaggtgaccgtattctccgtcgattgtagccgcctgaagaaatatcttctcctctctcgttgaaccacgaatttgctctgatattagtgtttctctagccatggtaagctcaattttccacttgttatctcgatctgcgaacgcggcatctggaatggctgtgcatgatgattgcaagctgagatttctggaactgaaggcgaaaaggacacaccgtttcatagtttacaagattgaggagaagcagaagcaagttgttgttgagaaagttggtcaaccgatccaaacttacgaggagtttgcagcatgtcttccagctgatgaatgccgttacgccatttacgattttgactttgtcactgctgagaattgccagaagagcaagatcttcttcatcgcgtggtgcccggatattgctaaggtgagaagcaagatgatctacgcaagctctaaggacaggttcaagagggaactagatgggattcaagtagagctacaggcaactgatccaacagagatggatctcgatgttttcaggagccgtgccaactaaaaagtaaaaaccaaagtttattatcatcatccccttgaaagatctattctcttattctgttatttttgagtgatggtactggtacttgattatgtttttacattgtgttgtgaagttatgaacctataaacaacttcattctatcggtgtttcggtcttgtgttcgatgttgtctttggttttaaaatggtgtgtaaggaccccaaatcgtctattgaagatgaacccttttaggtatatcattgatgaaatggatgattaaaagtttctctcacatttgtatgaaacaactgtctataggacaagattgatcttc

SEQ ID NO: 280 - DNA, 1159 bp, Arabidopsis thaliana
agctagaaagacaccagtcttaccctaacttttttcaaagtctgtgtctttctgtagaaatctgaggaataaatatttgaatctaaagagaataaagaagaaagtaaaaaagcaaaatcgaagttttgttcaattttctgggatcatagagcaattttcgtttctttattcgttgaaagtgtgaagcttttttgattcagtgagaagtgttaatggcgggttacagagcagatgatgattacgattacctattcaaggtggttctgatcggtgattcaggtgttggaaagtccaatttgctttctcgattcaccaggaacgagtttagtctcgagtctaaatcaacgatcggggtcgagttcgcgactcgtagcttgaatgttaatgaaaaagtcatcaaagcccagatttgggacactgctggtcaagaaagataccgagcaatcactagtgcttactatcgaggagctgttggggcgcttcttgtttacgacgtaacccgacactcaacattcgaaaacgttgagagatggctaagggaactccgtgaccacactgacccaaacatagttgtgatgcttgtgggaaacaaatccgatcttcgccatcttgtagcagtccaaaccgaagatgcaaaatcttttgcagagaatgaatcactctacttcatggaaacctcagctcttgaatctaccaatgttgagaacgcgttttctgaagtactcactcagatttaccatgttgtgagcaagaaagcaatggaggctggtgaagattccggtaatgttccttcgaaaggagagaagatcgatgttgatgtttccgcagtgaagaaaactggttgctgctccaactaaatggtcttatgtcctaaagctgaaatcggtttttaaattttacattcaaattttgtttttgaagatgtttgcttttttttaggaaaacaaactatgttatgccttttgatttgcttgtttgaaaattgcttagctttggtctgattctgtaccggttaagggattttgtaatttaaccggttctggtctatggtttgtttttaattcaatccgcaaatatctctaaaccaatatttattgtgctaatccttgaacacaactaatttttgttataccaatttagaaaattttcgtcaaaaaaa

SEQ ID NO: 281 - DNA, 3276 bp, Arabidopsis thaliana
tggttggctatatggtccaaattttgatttgcaatatgagattgcacagagagaacaatctttcattatgattaattattgtacaagtaacaaacaccaatctccaatatactttggctctttagcacattgttatgctagaagttagcggaaatctatatgttgttaaacgcagcgtttaaattgaacagtgtaatttaccttgaaattttaagactacatgctgtttagaatttcagatgaaaacatcttgatgttttagaaatccacgtgggaatagcgtaaaatcttatccaacgaacttattttggttttgttgtatttgtgcaagtcgtcacgctaatcgaaaaaagaaaagaaaaaaagaagccgtcatgatcggccatttctcggccgagtctgagtctgactctgcgtccgtgtcaccattatcagatcgagcctgtcttatctcgttgcgattccctatgcaaaaatcttcttcttttttttattcccccatttatctctgatctcttctctcttctcaagtaaacctctctgcttcacgtctcttcttttcttgtcgattttccccagataatcagttgaaaacacacccaaattcatcttcgaatcaataatggatataagtaatgaggctagtgtcgatcccttttcgattggaccatcatctatcatgggtcgaaccattgctttcagagtcttgttctgtagatcaatgtcacagcttaggcgtgatctctttcggttcttgttgcattggtttcttagatttaagctgaccgtttcaccgtttgtgtcgtggtttcatcctcggaaccctcaagggattttagcggtggttacaatcattgcctttgtgttgaaacgatacacgaatgtgaaaataaaggcggaaatggcttaccggaggaagttttggaggaatatgatgcggacggctttgacttatgaggaatgggctcatgctgctaagatgttagagaaggaaacaccaaagatgaatgaatctgatctttatgatgaagagttggttaagaacaagcttcaggagcttcgtcatcgtcgccaagaaggctcacttagagacattatgttttgtatgagagctgatttggtgaggaatctcggtaatatgtgtaattcggagcttcataaaggtagacttcaggttcctagacatatcaaagagtacattgatgaggtgtctactcagttgagaatggtttgtaactctgattcagaggagctttctttagaagagaagctttcttttatgcatgaaacacggcatgcctttggtagaacggctttgcttttgagtggtggggcttctcttggtgcgtttcatgttggtgtggttaggactttggttgagcataagcttttacctcgaataattgctggttctagtgttggatccatcatttgtgctgttgtggcctcaaggtcttggccagaactacagagtttctttgagaattctttgcattctttacagttctttgatcagctcggaggcgtgttctcaatagtgaaacgggtaatgacacaaggggctctacacgatatcagacagttgcaatgtatgcttagaaacctcacaagcaatctcacattccaagaagcttatgacatgacaggaaggattctcgggatcaccgtttgctccccaagaaagcatgaacctcctcggtgtcttaactatttgacttcgcctcatgtggttatatggagcgcagtgactgcttcttgtgcttttcctggtctctttgaagctcaagagctaatggctaaagatcgaagtggagagatcgtaccgtatcatccacctttcaatttggatccagaagtaggcactaaatcatcatctggacgccggtggagagatggtagtttggaggttgatttaccaatgatgcagcttaaagaactgttcaatgtcaatcattttattgtgagccaagccaatcctcacattgctccattactgcgtctaaaggatttagttcgagcttatggtggtagattcgcagctaagctcgcgcatctagtggagatggaggtcaaacatagatgcaaccaggtattagagctcggttttcctctcggtggactcgcaaagctttttgctcaggagtgggaaggtgatgttacagttgtaatgcctgctactcttgctcagtactcgaagattatacaaaatccgactcatgtcgagcttcagaaagcggctaaccaaggaagaagatgcacttgggagaagctctcagccataaaatcaaactgcgggatcgagcttgcgcttgatgattctgtagctattcttaaccatatgcggaggctcaagaaaagtgcggagagagccgccactgccacgtcttcgtctcatcacggattggcttcaaccaccagattcaatgcttcaagaagaatcccatcttggaacgtccttgccagagagaactcaacaggctcactggatgatctagtcactgacaataacctccacgcttcttcgggcaggaatttaagcgacagtgaaacagagagcgtggagttgagttcttggacaagaactggtggacctttaatgagaacagcttctgctaataagttcattgattttgttcagagtcttgatatcgacattgcattggtcagaggatttagtagcagtcccaattctccagcagttcctcctggtggctcgtttactccaagcccgagatccatagcggctcattcggatatcgaatcaaacagcaatagcaacaatcttggaacaagcacttcaagcataacagttactgaaggtgatcttctacagcctgagagaacgagtaacggatttgtgttaaacgtcgttaaaagagagaacttgggaatgccatcgattgggaaccaaaatacagagttaccagagagtgtacagctcgatataccggagaaggagatggattgtagctctgtatcagaacacgaagaagatgataacgacaatgaagaagaacataacggctcgagtctggttactgtttcttcagaagattccggtttacaagaaccggtgtctggtagtgttatagatgcttagagtgtgattgattcaagtgagtatagattcttaattaaatttgcagagtttccaaagggtttagtgcaccacttgtgtatgtttgtattgcttattgtttgaaattcatttgtgaaatcgaaatatatctgtaaattcagaaaatattctctcatccattacaaaatatttgagtc

SEQ ID NO: 282 - DNA, 1099 bp, Arabidopsis thaliana
gtctttctcgtttgatattttccaattccgcgtctttctctgttgaaatcgaaaaaattttcaaaacaaaatctaaggaaaaaagagcaacaagtttcaaatctcatttgggtttttcattttgaaaagaaggacccatttttatctctctctttgttttgttttctcgaatctgaaggagtaaagttaaaagctttgaaggagagaatcaatggcgggttacagagcagatgatgaatacgattacctattcaaggttgttctgataggtgattcaggtgtgggcaaatccaatttgctttcacgattcacgaagaacgagtttagtctcgagtcaaaatccacgatcggggtcgagttcgcgactcggagtttgaatgttgatgataaagtcatcaaagctcagatttgggatactgctggtcaagaaaggtaccgagccatcactagtgcgtattaccgaggagctgttggagcgcttcttgtctacgatgtaacccgacactcaacatttgaaaacgttgagacttggctgaaagaactcagaaaccacactgatccaaacattgtagtcatgctcgtgggcaacaaatctgaccttcgccatctcgtggctgttcagactgaagatgctaagtcattcgccgagaaagaatctctctacttcatggaaacctcggctctcgaagccaccaatgttgagaacgctttcgccgaagtcctcactcagattcaccacattgtgagcaagaaggcgatggaagctgcgagcgaatccgctaatgttccatcgaaaggagacaagatcgatatcggtaaagatgtttcagctgtgaagaaaggtggatgctgctcgaactaatcagagagtagaattattgttaacaacctaaggatcggtttttgttaacggttctatcgaatatgaagattgcttttaggttgagtaatgcccatttggtgtatttctgttatttatctgatctatcaatgttattgtttgaaaatgctatgtcaaattttcagaaccctaaattatatttatctcaaacaatagaattgttgaaaagaaaagataaaaatagtttctgcctttgat

SEQ ID NO: 283 - DNA, 881 bp, Arabidopsis thaliana
attcggaatttagcttccaaataacgcagaagaaagtaaagagagaagaagcaaaaagagtcatattcgttgaaaacatcattcactcttctctgcgtctccttctttcacccgaaattgtctctgacaccgttttgattcagccatggctaatgctgcgtcaggaatggcagtccatgatgactgcaagctaagatttctggaactgaaggcgaaaaggacacaccgtttcattgtctacaagattgaggagaagcagaagcaagtgattgttgagaaagttggtgaacctattctaacttacgaggactttgcagcaagtcttccagctgacgaatgccgatacgccatttatgatttcgactttgtcactgcagagaattgccagaagagcaagattttcttcattgcatggtgtcccgacgtagcaaaggtgagaagcaagatgatctatgcgagctctaaggacaggttcaagcgtgaacttgatggaattcaagtggagcttcaagcaactgatccaactgagatggatcttgatgttttgaaaagccgcgtcaactaaaagaaactctctttgaataagcttccgattatattcgactattatgaaatggtgttttctattctcttacagtctcttgtgactgttagatacacttgacacccttcattctatctgtctggtctgttctctgtgtctatgttaccttacagtgtctcatctatattcaaaattatcacaaggtttgtgctgtgtttgcttcctttgtttcaactctaccaaagcttaagattaagatttgggtaagatgattcttttaagcttccctttgttctctttgttacagagggtataaaaaatgcaaaaactattcacc

SEQ ID NO: 284 - DNA, 728 bp, Brassica oleracea
gacgcgtgggaggctttccgcataaagctgggggaaacggaagagaaaagaaaagacgcacaccgtagacgagtccatcgtctctccagcttcttcttcgtctctgaaactaatctgattcatccatggctaatgcagcgtcaggcatggcagtccacgatgactgcatgctcaagtttcttgaactcaaggcgaagaggacataccgtttcattgtttacaagatcgaggagcagcagaagcaagtggttgtggaaaaactaggcgagcctggtcaatcccatgatgactttgctgcaagtcttcctgctgacgagtgccgatacgccatctttgattttgatttcgtcactgctgagaactgccagaagagcaagattttcttcatcgcatggtctccggacacggcaagagtgagaagcaagatgatctatgcgagctctaaggacaggttcaagagggagctagacgggattcaagtagagcttcaagcgaccgatccaactgagatggatctcgacattttcaaaagccgagccaattgaggaacggttgtatcaaactttgttgcttctgttatcagagtgatatgctttatcttaaagtttgctgtgacggcaccaaccaaaacagcttcatttcatcggtctttgtcttcagtgtcttttctttttctttttggttcttacagtgtcttgcttaaaacttaagagacttggcttctgctc

SEQ ID NO: 285 - DNA, 683 bp, Brassica oleracea
gggggaaacggaagagaaaagaaaagacgcacaccgtagactccatcgtctctccactctccagcttcttcttcgtctctgaaactaatctgattcatccatggctaatgcagcgtcaggcatggcagtccacgatgactgcaagctcaagtttcttgaactcaaggcgaagaggacataccgtttcatcgtgtacaagattgaggagcagcagaagcaagtggttgtggagaaactcggcgaacctggtcaatcccatgatgactttgcagcaagtcttcctgctgacgagtgccgctacgccatcttcgattttgatttcgtcactgctgagaactgccagaagagcaagattttcttcatcgcatggtctccggacacagcaagagtgagaagcaagatgatctatgcgagctctaaggacaggttcaagagagagctagacgggattcaagtagagcttcaagcaaccgatccaactgagatggatctcgacattttcaaaagccgagccaattgaggaacggttgtatcaaactttgtcgcttctgttatcagagtgatatgctttatcttaaagtttgctgtgacgccaccaaccaaaacagcttcatttgatcggtctttgtcttcagtgtcttttctttttctttttggttcttacagtgtcttgcttaaaactt

SEQ ID NO: 286 - DNA, 791 bp, Brassica oleracea
gaacgcagaagaaaggaaaagagaagaaaaaacatccgtcacctctccgtcacctttcacccgaaactgtctcttgacagcgttttgattcagcaaccatggctaatgcggcttcggggatggcagtccatgatgactgcaagctcaggtttctcgaactcaaggccaaaaggactcaccgtttcattgtttacaagatcgaggagaagcagaagcaagtggttgttgagaaagttggcgaacctgttctatcctatgaggactttgctgctagcctccctgctgaagaatgccgttacgccatttatgatttcgactttgtcactactgagaactgccagaagagcaagattttcttcattgcttggtgtccggatgtagcaaaggtgagaagcaagatgatctacgcgagctccaaggacaggttcaagcgtgagcttgatgggattcaagtggagcttcaggctactgatccaactgagatggatcttgatgttttcaaaagccgcgtcaactaaaaagaataagctttttctttggctcatattctatctactattcctgaatggtgttttcttttctctatacagtttcttgcaactgtgatgaaaacctaactccccttcactctatatccacctggtctgtcttctgcgtctttgttaccatacagtgttttattttatattgaaaatgyccccgaggtttgtgctgtgtttggatcctattgtgtaaagatgtttcctttaagcgtttgttctcgttttctaccgtatgacagaaaaagtcca

SEQ ID NO: 287 - DNA, 733 bp, Brassica oleracea
ggcacaaccgaagactcccaccatctctcctccagcttcttcttcttcgtctctgaaactagtttgattcagccatggctaatgcggcgtcaggtatggcagtccatgatgactgcaagctcaagtttctcgaactcaaggctaaaaggactttccgtttcatcgtttacaagatcgaggagcagcagaaacaagtggttgttgagaagctcggcgagcctggtcaatcccatgatgactttgcagctagtcttcctgctgatgaatgccgttacgcagttttcgattttgatttcgtcactgctgagagttgccaaaagagcaagatcttcttcgtcgcatggtctccggacacagcaagagttagaagcaagatgatctacgcgagctccaaggacaggttcaagagagagcttgayggaattcaagtagagcttcaagctaccgatccaactgagatggatctcgatgttttcaaaagccgagccaactgaggaatacatcctccataaaagaattggttgaatccaactttctcctactattactgaattgatatatgcttgttctttaagtttgctgtgaaggcaccaccaaaccaaaacaacttcatttcattggtctttgtcttcctatgtcttctatattttttttggtccttgcagtgttttgcttaaaacttaagagatttggcttgtactcttytaccatttgtgtaagaaaacccaaaccc

SEQ ID NO: 288 - DNA, 771 bp, Brassica oleracea
gacgaaacagtgaagaaacaaaaaaaaaacacaagtcatatcgttttttaccgaccggagaaaaatatctttcttccgcttcttcattttcacaagagttatcgttggaatcggttagccatggctaacgcggcatcaggaatggctgtgcatgatgattgcaagctcaaatttttggaactgaaagccaaaagaacattccgtacgatagtctacaagattgaggacaagcaagtgattgtggagaaactcggtgagcctgaacagtcatacgatgactttgcagcaagtcttccagataacgaatgccgttatgccatttatgacttcgactttgtcactgaggagaactgccagaagagcaagattttcttcatcgcatggtctcctgacactgccaaagtgagagacaagatgatttacgcgagctctaaggataggttcaagagagaactggatgggattcaagtggagcttcaagcaaccgatccaaccgagatgggtcttgatgttttcaagagccgcaccaactaaagcctaaaccgcccccccccccccccccccgtgaaccgggggggccttgaataaatttgtttcaggagtgacgattatgaaacttttaacatcttcattctgtttgggtattgttattgtctttggtgtcttgatgatgtttccatcatctatgaacttgtgagattgtgctgccttgccttgtggtggttggcaatcttttgtgtcagtttactatgtacaatactttgaaaaatc

SEQ ID NO: 289 - DNA, 717 bp, Brassica oleracea
ggaggaaaaggaagagaaaagacgcacaccgaagaaaaaacaaagacttcatcttcatcatctcctgcttcttcttctcagcaagaaactagtttgattcagccatggctaatgcagcgtcaggaatggcagtccacgatgactgcaagcttaagtttcttgaattgaaggccaagaggacataccgtttcattgtctacaagattgaggagcagcagaagcaagtggttgttgagaaactcggcgagcctggtcaatcccatgatgactttgctgctagtcttcctgctgatgaatgccgatacgccattttcgattttgatttcgtcactgctgagaattgccaaaagagcaagatcttcttcgttgcatggtctccggacacggcaagagtgagaagcaagatgatctacgcgagctctaaggacaggttcaagagagagctagacgggattcaagtagagcttcaagcaaccgacccaaccgagatggatctygaygttttcaaaagccgagccaattgagcaacggttraatcgaacttctttcatctactattgccgagtgatatgcttttacatatggtttgctgtgacggcaccatcccaaaacaacttcatttttatctgtctttattttatttttggtccttaagtgttgtcttaaaacctaagagatctggcttcgttctccatacctccaccccgatgccctccg

SEQ ID NO: 290 - DNA, 688 bp, Brassica oleracea
ggaggaaaaggaagagaaaagacgcacaccgaagaaaaaacaaagacttcatcttcatcatctcctgcttcttcttctcagcaagaaactagtttgattcagccatggctaatgcagcgtcaggaatggcagtccacgatgactgcaagcttaagtttcttgaattgaaggccaagaggacataccgtttcattgtctacaagattgaggagcagcagaagcaagtggttgttgagaaactcggcgagcctggtcaatcccatgatgactttgctgctagtcttcctgctgatgaatgccgatacgccattttcgattttgatttcgtcactgctgagaattgccaaaagagcaagatcttcttcgttgcatggtctccggacacggcaagagtgagaagcaagatgatctacgcgagctctaaggacaggttcaagagagagctagacgggattcaagtagagcttcaagcaaccgacccaaccgagatggatctygaygttttcaaaagccgagccaattgagcaacggttraatcgaacttctttcatctactattgctgtgacggcaccatcccaaaacaacttcatttttatctgtctttattttatttttggtccttaagtgttgtcttaaaacctaagagatctggcttcgttctccatacctccaccccgatgccctccg

SEQ ID NO: 291 - DNA, 853 bp, Brassica oleracea
gaagccaccgtcgactttagttaactctctctctctctctctctctactccgtctcagatttctcttctccgctcggaaaagctccaaactttgctctgcaaatcctaatcttccgatgtcgatcttcgagtacaatggaagcgccgtcgtggcaatggtggggaagaactgcttcgccatcgctagtgatcggaggctaggtgtgcagctgcagacaatcgccaccgatttccagaggatctcaaagatccacgatcgtgtcttcatcggcctctctggtctcgccaccgatgtccaaacactgtaccagcgccttgtgttccgtcataagctgtaccagcttcgggaagagagagacatgaagccggaaactttcgccagtctcgtctccgccattctttacgagaagagatttggtccttacttgtgccaaccagtgattgctggattgggagaagatgacaagcccttcatctgcaccatggactccattggtgccaaggagttggctaaagatttcgttgtatctggaactgcttcagaatcactgtatggggcctgcgaagcaatgtacaagccagayatggaagccgaggaactgtttgagacgatwtcrcaagcacttctgtcgtcagttgaccgagattgtytgagtggttggggaggtcatgtctacgttgtaacaccaactgagattaaagagaggatcctaaagggaaggatggattaatctgatcagctatatcatctttcatctgcttctatccaagttgttgttttttgcctttgtaaactggttttatgtagaataaccatcgcatccccggtttaagcatagaacgatttcttctt

SEQ ID NO: 292 - DNA, 741 bp, Brassica oleracea
ggggggacattaataattattatgattatatatagcttccaaataacgccgaacaaaaaggaaaagaaagactcatattcgaaaaaagatcttcgtcttctctgcgtctcctttcagcagtctttgacatcgtcttgattcagccatggctaacgcggcgtcgggaatggcagtccatgatgactgcaagctaaggttcctggaactgaaggcgaagaggacgcaccgtttcattgtttacaagatcgaggagaagcagaagcaagtgattgttgagaaagttggtgagcctattcaaacctacgaggactttgctgcgagcctcccagctgaagagtgccgatacgccatttatgacttcgactttgtcactgcggagaattgccagaagagcaagattttcttcattgcgtggtgtcctgacgtagcaaaggtgagaagcaagatgatctatgcgagctccaaggacaggttcaagcgtgagcttgatggaattcaagtggagcttcaagcgactgatccaactgagatggatcttgatgttttcaaaagccgtgtcaattaaaaaacaaatattctctctctctctctctctctttgaataagcttctttggctcttacagtttcctgcgactgtataaaaacataacgccctttattctatccttatctggtctcgtcttctgcgtcgttgttaccgaacagtgttttcatcttatattgaaagttatcccaacgtt

SEQ ID NO: 293 - DNA, 765 bp, Brassica rapa
cccacgcgtccgcggagaaaaatatctttcttccgcttctttattttcaacragagttatcgttggaatcggktagccatggctaacgcggcatcaggaatggctgtgcatgatgattgcaagctcaaatttttggaactgaaagccaaaagaacattccgtaccatagtctacaagattgaggacaagcaagtgattgtggagaaactcggtgagcctgaacartcgtacgatgactttgcagcaagtcttccggagaacgaatgccgttatgccatttatgacttcgactttgtcactgaggagaactgccagaagagcaagattttcttcatcgcatggtctcctgacactgccaaagtgagagataagatgatttacgcaagctctaaggataggttcaagagagaactggatgggattcaagtggagcttcaagcaaccgatccaaccgagatgggtcttgatgttttcaagagccgcaccaactaaagcctaaacaccccccctgtgaaccggggggacttgaataaatttgtttctggagtgattttatgtgtctgttaactgtttcctctgacggttatgaaacttttaacatcttcattcggtttgggtattgttattgtctttcgtgtcttgatgatgtgttttcatcatctatgaacttgtgagattgtgctgccttgccttgtggtggttggcaatcttttgtgtcagtttactatcttttttttttgacatgtgtcagtttactatctatgt

SEQ ID NO: 294 - DNA, 667 bp, Brassica rapa
gaaactagtttgattcagccatggctaatgcggcgtcaggaatggcagtccacgatgactgcaagctcaagtttcttgaattgaaggccaagaggacataccgtttcatcgtctacaagattgaggagcagcagaagcaagtggtcgttgagaaactcggcgagcctggtcaatcccatgatgactttgcagctagtcttcctgctgatgaatgccgatacgccattttcgattttgatttcgtcactgctgagaattgccaaaagagcaagatcttcttcgttgcatggtctccggacacggcaagagtgagaagcaagatgatctacgcgagctctaaggacaggttcaagagagagctagacgggattcaagtagagcttcaagcaaccgacccaaccgagatggatctcgacgttttcaaaagccgagccaattgaggaaccggttgaatcgaacttctttcatctactattgccgagtgatatgcttttacttaaggtttgctgtgacggcaccaaccaaaaaacagcttcatttttatctgtctttattttattttggtccttacagtgttgttgtcttaaaactcaagagatctggctcgtgctcttattaccctaaaccctctatcaaaaaatgaatcctatttagcacattttgtctt

SEQ ID NO: 295 - DNA, 756 bp, Brassica rapa
ggggggaaaaggaggagaaaaggaaagacgcacgcacaccgtagactccatcatcgtctctccagctcttcttcgtctctgaaactaatctgattcatccatggctaatgcagcgtcaggcatggcagtccacgatgactgcaagctcaagtttcttgaactcaaggcgaagaggacataccgtttcatcgtctacaagatcgaggagcagcagaagcaagtggttgttgagaaactcggcgagcctggtcaatcccatgatgactttgcwgcaagtcttccagctgatgagtgccgctacgccatcttcgattttgatttcgtcactgctgagaactgccagaagagcaagattttcttcatcgcatggtctccggacacagcaagagtgagaagcaagatgatctatgcgagctctaaggacaggttcaagagagagctagacgggattcaagtagagcttcaagcgaccgatccaactgagatggatctcgacattttcaaaagccgagccaattgaggaacggttgtatcaaactttgttgcttctgttaccagagtcatatgctttatcctaaagtttgctgtgacggcaccaaccaaaacagcttcatttgatcggtctttctcttcagtgtcttttttttttgggttcttacagtgtcttgcttaaaacttaaagagatttggyctgtgctcttttataatcgtgtaagaaacccaaaccgtttatcaacagatgatcctattggaacg

SEQ ID NO: 296 - DNA, 453 bp, Brassica rapa
cccacgcgtccgtaacgtcagaaacttcgatgtggtgcctcaggagtgcgtgtcgcacgtcaagaagtacatgacgtcgtcgcagtacgaagatgacgtggagagagccgttgatgaggtcatccttcatttcgggagcatgtgttgtaccaaaacaaagtgtgatggcatggatgcttggatctttgacatcgatgacacgcttctctctaccattccgtaccacgagaagaatggcttctttggaggagagaagttgaactctacaaaatttgaagattggatgaggaagaggaaagcaccaccagtgccacacatggtgaaactgtaccatgacatcagagaaagaggcatcaagatcttcttggtctcttcccggaaagaatatctcagatctgccaccgttgacaacctcatccaagccggtactatggctggtccacctcatcctca

SEQ ID NO: 297 - DNA, 650 bp, Brassica rapa
agactccatcatctcctccagcttcttcttcttcgtctctgaaactagtttgattcagccatggctaatgcggcgtcaggtatggcagtccatgatgactgcaagctcaagtttctcgaactcaaggctaaaaggactttccgtttcatcgtttacaagatcgaggagcagcagaaacaagtggttgttgagaagctcggcgagcctggtcaatcccatgatgactttgcagcttctcttcctgctgatgaatgccgttacgccgttttcgatttcgatttcgtcactgctgagagttgccagaagagcaagatcttcttcgtcgcatggtctccggacacagcaagagtgagaagcaagatgatctacgcgagctctaaggacaggttcaagagagagcttgacggaattcaagtagagcttcaagctaccgatccaactgagatggatctcgatgttttcaaaagccgagccaactgaggaatacatcctccataaatgaattggttgaatccaaatttctcctactattactgaattgatatatgcttgttctttaagtttgctgtgaaggcaccaccaaaaccaaaacagcttcatttcattggtctctgtcttccctatgtcttttatattttttttttggtcct

SEQ ID NO: 298 - DNA, 618 bp, Brassica rapa
gaacgcagaagaaaggaaaagaggagaaaaaaaacatccgtcttctctccgtcacctttcaccagcgttttgatccagcagccatggctaatgcggcttcggggatggcagtccatgatgactgcaagctcaggtttctcgaactcaaggccaaaaggactcaccgtttcattgtttacaagatcgaggagaagcagaagcaagtggttgttgagaaagtcggtgaacctattctatcctatgaggatttcgctgctagcctccctgctgaagaatgccgttacgccatttatgatttcgactttgtcactactgagaactgccagaagagcaagattttcttcattgcttggtgtccggatgtagcaaaggtgagaagcaagatgatctacgcgagctccaaggacaggtttaagcgtgagcttgatgggattcaagtggagcttcaggctactgatccaactgagatggatcttgatgttttcaaaagccgcgtcaactaaaaagaataagctttctttggctcgtattctatctactattcctgaatggtgttttcttttctctatacagtttcttcttgcaactgtgataaaaacctaactccccttcactctc

SEQ ID NO: 299 - DNA, 730 bp, Brassica rapa
gagcgtgtctgtcaccactttaccacttatcaaagcttcccaagctgtgtaaaattctctccacaatccacaatcacttccaaagaacttcaagaagatgggtaaggaagacaatcaaggagaagagtacctcttcaagattgtcctaatcggcgactccgcggtcggaaaatcgaacctcctgtctcgattctctcgwgacgagttcgacaccaactccaaggcgaccatcggagtggagttccagacgcarctggtggagatcgaagggaaagargtgaaagctcagatctgggacactgctggtcaggagaggtttagagccgtcacttctgcttattacagaggtgcttttggtgctctcattgtctacgacatcaccagaagctccactttcgagagtgttaaacgatggcttcaagaactcaacactcattgtgacacagcagtggcacaaatgctagttgggaacaagtgtgatttggaggatatcagagctgtgagtgtggaagaagggaaagctctcgcggaggaagaagggttgttcttcatggagacatctgctcttgacgctacgaacgttgacaaggcctttgagattgtcatcagagagattttcagtaatgttagccgcaaacttctcaactccgatgcttacaaggctcagctttctgttaaccgtgtcagtcttgttaacaacggtgatgggcgcacagagctcttcttgttg

SEQ ID NO: 300 - DNA, 769 bp, Musa acuminata
ggggatcccttttgggtttgtgctctccgcgaacctctgttctcagaccacccgtttctctctccctagattttctccaccgatctcttcgctgcaatcgccgcccccttaagaatggcaaacgcggcatctggaatggcagtcaacgacgactgcaagcttaaattcttggaattgaaggcgaaaagaacttaccgtttcgtaatattcaagatcgacgagaagcagaaggaggtcgttgtggagaaggtcggcgagccctcctcgagctatgaggattttgctgccagcctccctaccgatgaatgcagatatgctatatatgactttgattttgtgactgaagagaacttgcaaaagagtaagatcttttttattgcatggtcccctgactcctcaagagtgagaagcaagatgctttatgcaagctccaaggacagattcaagagggagttggatggtatccaggtcgaactgcaagcaactgatcctacggagatgggcctcgatgtctttagaagccgtgcaaattgagcatctcctgataattcagaggaagtgtacctcctgcaagctagttgatcataatgtttatagttccaaacatggtgaattcactagataccatctggtcttctttgcctcctttatgcatctttcaatttggtacatcttgctgaactgtttcctggtcagacctatgacataagtttctacatgcagcctgatttttacaagctgatcgtatttgtggttctgctggtttgac

SEQ ID NO: 301 - DNA, 809 bp, Musa acuminata
caccaagccacctttctcttccttcgcgctcgtcttcgtctcttctctctcctcgctgactgatgtcgatctttgagtacaatgggagcgccctggtggcgatggtcgggaagaattgctttgcgatcgccagcgaccgccgccttggggttaacctccagaccgtcgctactgatttccagaggatcttcaagatccacgacaagctctacatcggcctctctggcctcgccaccgacgcccaaaccatgtaccagcggctggtctttcgccacaagctttatcagctgagggaggaaagggatatgaagccccagacttttgccagcctcgtttcggctctgctgtatgagaaaagatttggtccatacttctgtcagcctgtaattgctggactaggtgacgatgatgttccattcatttgtaccatggattgccttggtgccaaggaacttgccaaagattttgttgtctctggtacagcctcagagtctctttatggtgcttgtgaatccatgtacaagcctaacatggaacctgaagaattgtttgagacaatctcacaagctttattatcgtctgtggatcgtgattgtttgagtggttggggagggcatgtccttcttgtgacaccaaccgaagtgcaggaaagaaccttaaagggaaggatggattaagtctgatttaaattgaacataagttcatattttccttgaattctgctttccttggtggaagccaacagactgtaattttgtctttaaggccataatgtgagactgtagttcttggatcagtttcttctcgtt

SEQ ID NO: 302 - DNA, 1036 bp, Hordeum vulgare
cggcacgaggccacttcccccgaccaccagcagcgccggcgacccctcctcctccttcccccactccaatcgaacccggcgaccccgcgactccggccggccatgtcgatcttcgagtacaacggctccgccgtggtggcgatggtggggaagaactgcttcgccatcgccagcgaccgccgcctcggcgtccagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgcgacatgaagcccgagaccttcgccagcctcgtctcctccatgctctacgagaagagatttgggccgtacttctgccagcctattattgctggacttggacaggatgacgagccatttatttgtaccatggactgcattggtgcaaaggaacttgctaaggattttgttgtctcagggacagcatcagagtctctatatggtgcctgtgaatccatgtacaaaccgaacatggaacctgaggaactcttcgagaccatatcacaagctctgttgtcatcagttgatcgtgactgtctcagtgggtggggaggctatgttctgattgtgacaccgaccgaagttcaagagcgagtgctaaagggcaggatggactagatgaaggcctagagttcttcagcggcttccggatatgcttctacgcttgctgtttcgacatccctgttgtgccccagttccgaagcaaccttgtactgtcaaaaatcgatgttatttatccgtagaagagacatttgttttcttttacttatatatcctttttatatgaagtgaatggtgaggcatctcctcgtggtgaaacatattgaatcatcattttctctaagtttagggatggtaacggtaaaccttacactgggtaaggttcaaaaaaatgtattgcaacaagggatcgcactgtaaaaatgtatctactcta

SEQ ID NO: 303 - DNA, 913 bp, Hordeum vulgare
ccgaacggactcgccgcttttcttttcgtcgccggatacacaaccgaagccgccgtgctccgccgcctcctctcgctccgcctccgccttcgccgtctgttgcatccctgtcggccatgtcgatcttcgagtacaacgggagcgccgtggtggcgatggtggggaagaactgcttcgcgatcgccagcgaccggcgcctgggcgtgcagctgcagaccgtcgccaccgacttccagagggtgttcaagatccacggcaagctgtacatcggcctctccggcctcgccagcgacgcccagacgctgtaccagcggctggtgtttaagcacaaattgtaccagcttcgggaggagagggacatgaagcctgagaccttcgccagccttgtctcggccctcctctacgagaaaaggtttgggccatacttctgccaaccaattattgctgggctaggtgaaaatgatcagccatttatatgtaccatggactgcattggtgccaaggaactggcaaaagattttgtggtttctggtactgcttcggaatcactatatggtgcttgtgagtccatgtacaaaccagacatggaacccgaagaactatttgagacaatctcacaagcattgctttcttctgttgaccgcgattgcctgagtggttggggaggttatgttcttattgtaacacccactgaagttcaggagagagtgcttaagggaaggatggactgatttcgcaacacctgtagtcctagatcacataggagattgttcctttattctcgacctactaaaacctgtgtgatctgctctttctgtgcactcgtgttcaaacctataacttggattttaacatgccactgaagtctgaaatctgaaatcaaaatcatgtgtgcctgtgcacagcggccgcc

SEQ ID NO: 304 - DNA, 945 bp, Ocimum basilicum
cggttccacctacagctttaattattgatttgtttctgcatctgaatcaacacctaaatgtcgatctttgagtataatgggagcgccttggtggcaatggttgggaagaactgcttcgcgatcgccagcgaccggcgcctcggcgtgcagctacagacgatcgccaccgactttcagaagatttacagaatccacgataagcttttcatcgctctcgctggcctcgctactgatgcgcaaactctgtatcagaagcttgtttttcgacacaagctgtatcatcttagggaagagagggatatgaagcctgaaacatttgctagccttgtatctgcacttctctatgagaagaggtttggwccattcttttgccaacctgttattgctggactgggagacgatgacaaacccttcatttgcaccatggattccattggggcaaaggagcttgccaaagattttgttgttgctggtactgcctccgaatcactctatggtgcctgcgaatcaatgttcaaacctgacatggaagctgaggaattgttcgagaccatctcacaggcgctactggcatcagtagaccgtgattgtttgagtggctggggagggcatgtttayctcgtcacacccactgaagttaaagagagaattctcaagggaagaatggattgatttttccagcaacaaggctatgtctcaaaattctaccctagtggttcgataatgttgtagkgacaatccattgattgttgatgattggatgttaaattgctaggcttttttcatgtccaaaacatggatttcatactgttgcaagcaagaatttcataccattagcaatgtggagatgtcaatctggcccactataatttcacaacagatcttttatattctacttgtaaccaaaaagaaaaatagtatctgttattttgagttgggatttta

SEQ ID NO: 305 - DNA, 781 bp, Brassica napus
gggggggggaaaaggaagagaaaagaaaagacgcacaccagcttcttcttcgtctctgaaactaatctgattcatccatggctaatgcagcgtcaggcatggcagtccacgatgactgcaagctcaagtttcttgaactcaaggcgaagaggacataccgtttcatcgtgtacaagattgaggagcagcagaagcaagtggttgtggagaaactcggcgaacctggtcaatcccatgatgactttgcagcaagtcttcctgctgacgagtgccgctacgccatcttcgattttgatttcgtcactgctgagaactgccagaagagcaagattttcttcatcgcatggtctccggacacagcaagagtgagaagcaagatgatctatgcgagctctaaggacaggttcaagagagagctagacgggattcaagtagagcttcaagcaaccgatccaactgagatggatctcgacattttcaaaagccgagccaattgaggaacggttgtatcaaactttgtcgcttctgttatcagagtgatatgctttatcttaaagtttgctgtgacgccaccaaccaaaacagcttcatttgatcggtctttgtcttcagtgtcttttctttttctttttggttcttacagtgtcttgcttaaaacttaaagagatttggcctgtgctcttttataatcgtgtaagaaacccaaaccgtttatcaacagatgatcctattggaacattgtctctcatctacatgagatgcctagtgatccagggattta

SEQ ID NO: 306 - DNA, 790 bp, Brassica napus
gaacgcagaagaaaggaaaagaggagaaaaaaaacatccgtcttctctccgtcacctttcaccagcgttttgatccagcagccatggctaatgcggcttcggggatggcagtccatgatgactgcaagctcaggtttctcgaactcaaggccaaaaggactcaccgtttcattgtttacaagatcgaggagaagcagaagcaagtggttgttgagaaagtcggtgaacctattctatcctatgaggatttcgctgctagcctccctgctgaagaatgccgttacgccatttatgatttcgactttgtcactactgagaactgccagaagagcaagattttcttcattgcttggtgtccggatgtagcaaaggtgagaagcaagatgatctacgcgagctccaaggacaggtttaagcgtgagcttgatgggattcaagtggagcttcaggctactgatccaactgagatggatcttgatgttttcaaaagccgcgtcaactaaaaagaataagctttctttggctcgtattctatctactattcctgaatggtgttttcttttctctatacagtttcttcttgcaactgtgataaaaacctaactccccttcactctatttccatctggtctctcttctctgtctttgttaccatgcagtgttttattttatattcaaaatgtccccgaggtttgtgctgtgtgttggatcctattgtgtaaagatgtttcctttgcgtttgctctctggatgagaaatgcaaaaagtataaagctttattaatactcag

SEQ ID NO: 307 - DNA, 814 bp, Brassica napus
gggagacgaaacagtgaagaaaaaacaaaaaaaacacaagtcatatygttttttgccgaccggagaaaaatatctttcttccgcttcttcattttcaacaagagttatcgttggaatcggttagccatggctaacgcggcatcaggaatggctgtgcatgatgattgcaagctcaaatttttggaactgaaagccaaaagaacattccgtaccatagtctacaagattgaggacaagcaagtgattgtggagaaactcggtgagcctgaacagtcatacgatgactttgcagcaagtcttccagataacgaatgccgttatgccatttatgacttcgactttgtcactgaggagaactgccagaagagcaagattttcttcatcgcatggtctcctgacactgccaaagtgagagataagatgatttacgcaagctctaaggataggttcaagagagaactggatgggattcaagtggagcttcaagcaaccgatccaaccgagatgggtcttgatgttttcaagagccgcaccaactaaagcctaacccccccccccccttgtgaaccgggggggccttgaataaatttgtttcaggagtgattttatgtgtctgttaactgtttcctctgacgrttatgaaacttttaacatcttcattcggtttgggtattgttattgtctttcgtgtcttgatgatgtgttttcatcatctatgaacttgtgagattgtgctgccttcctkgtggtggtggcaatcttttgtgtcagttactatctatgtacaatactttgaaaaatcagattggagttt

SEQ ID NO: 308 - DNA, 801 bp, Brassica napus
ggcagaaagccgacgaaaaggcagagaaaagacgcacaccgaagaaaaacacaaagacttcatcatcatcatctcctccttctttcgcctcagcaagaagctaatctgattcagccatggctaatgcggcgtcaggaatggcagtccacgatgactgcaagctcaagtttcttgaattgaaggccaagaggacataccgtttcatcgtctacaagattgaggagcagcagaagcaagtggtcgttgagaaactcggcgagcctggtcaatcccatgatgactttgcagctagtcttcctgctgatgaatgccgatacgccattttcgattttgatttcgtcactgctgagaattgccaaaagagcaagatcttcttcgttgcatggtctccggacacggcaagagtgagaagcaagatgatctacgcgagctctaaggacaggttcaagagagagctagacgggattcaagtagagcttcaagcaaccgacccaaccgagatggatctcgacgttttcaaaagccgagccaattgaggaaccggttgaatcgaacttctttcatctactattgccgagtgatatgcttttacttaaggtttgctgtgacggcaccaaccaaaaaacagcttcatttttatctgtctttggtctctgtctttattttattttggtccttaagtgttgtcttaaaacctaagagatctggctcgttctcttttaccctaaaccctytatcaaaaaatgaatcctattagcacatttttgtcttaagcatgttttgtgaaacttgtggtgaata

SEQ ID NO: 309 - DNA, 792 bp, Brassica napus
atctatatatataatacggagtatagcttcaaagcaacgcagaagaaaggaaaagagaagaaaaaaacatccgtcttctctccgtcacctttcacccgaaactgtctcttgacagcgttttgattcagcaaccatggctaatgcggcttcggggatggcagtccatgatgactgcaagctcaggtttctcgaactcaaggccaaaaggactcaccgtttcattgtttacaagatcgaggagaagcagaagcaagtggttgttgagaaagttggcgaacctgttctatcctacgaggactttgctgctagcctccctgctgaagaatgccgttacgccatttatgatttcgactttgtcactactgagaactgccagaagagcaagattttcttcattgcttggtgtccggatgtagcaaaggtgagaagcaagatgatctacgcgagctccaaggacaggttcaagcgtgagcttgatgggattcaagtggagcttcaggcaactgatccaactgagatggatcttgatgttttcaaaagccgcgtcaactaaaaagaataagctttttctttggctcatattctatctactattcctgaatggtgtttgcttttctctatacagtttcttgcaactgtgatgaaaacctaactccccttcactctatatccacctggtctgtcttctgtgtctttgttaccatacagtgttttattttatattgaaaatgtccccgaggtttgtgctgtgtttggatcctattgtgtaaagatgtttcctttaagcgtttg

SEQ ID NO: 310 - DNA, 676 bp, Brassica napus
ggaaaaagaaaagatcatattcgaaaaaagatcttcgtcgtcttctctgcgtctcctttcagcagtctttgacatcgtcttgattcagccatggctaacgcggcgtcgggaatggcagtccatgatgactgcaagctaaggttcctggaactgaaagcgaagaggacgcaccgtttcattgtctacaagatcgaggagaagcagaagcaagtgattgttgagaaagttggtgagcctatccaaacctacgaggactttgctgcgagcctccctgctgaagagtgccgatacgccatttatgattttgattttgtcaccgcggagaattgccagaagagcaagattttcttcattgcttggtgtcctgacgtagcgaaggtgagaagcaagatgatctacgcgagctccaaggacaggttcaagcgtgagcttgatggaattcaagtggagcttcaagcgactgatccaactgagatggatcttgatgttttcaaaagccgtgtcaattaaaaaaaaaacaaatatcatctctctctctttgaataagcttctttggctcttacagtttcctgtgactgttataaaaacataacgctcttttattctatcttatctggtcctgtgttctgcgtcgttgttaccgaacagtgttttcatcttatattgaaagtttatc

SEQ ID NO: 311 - DNA, 687 bp, Brassica napus
tgggggggaaaaggaggagaaaaggaaagacgcacgcacaccgtagactccatcatcgtctctccagctcttcttcgtctctgaaactaatctgattcatccatggctaatgcggcttcggggatggcagtccacgatgactgcaagctcaagtttcttgaactcaaggcgaagaggacataccgtttcatcgtctacaagatcgaggagcagcagaagcaagtggttgttgagaaactcggcgagcctggtcaatcccatgatgactttgcagcaagtcttccagctgatgagtgccgctacgccatcttcgattttgatttcgtcactgctgagaactgccagaagagcaagattttcttcatcgcatggtctccggacacagcaagagttagaagcaagatgatctatgcgagctctaaggacaggttcaagagagagctagacgggattcaagtagagcttcaagcgaccgatccaactgagatggatctcgacattttcaaaagccgagccaattgaggaacggttgtatcaaactttgttgcttctgttaccagagtcatatgctttatcctaaagtttgctgtgacggcaccaaccaaaacagcttcatttgatcggtctttctcttcagtgtcttttttttttgggttcttacagtgtcttgcttaaaacttaaagaga

SEQ ID NO: 312 - DNA, 769 bp, Brassica napus
gggactgataggcttccgcataaatcagaggaaaaggaagagaaaaagacgcacaaccgaagactcccaccatctctcctccagcttcttcttcttcgtctctgaaactagtttgattcagccatggctaatgcggcgtcaggtatggcagtccatgatgactgcaagctcaagtttctcgaactcaaggctaaaaggactttccgtttcatcgtttacaagatcgaggagcagcagaaacaagtggttgttgagaagctcggcgagcctggtcaatcccatgatgactttgcagctagtcttcctgctgatgaatgccgttacgcagttttcgattttgatttcgtcactgctgagagttgccaaaagagcaagatcttcttcgtcgcatggtctccggacacagcaagagttagaagcaagatgatctacgcgagctccaaggacaggttcaagagagagcttgatggaattcaagtagagcttcaagctaccgatccaactgagatggatctcgatgttttcaaaagccgagccaactgaggaatacatcctccataaaagaattggttgaatccaactttctcctactattactgaattgatatatgcttgttctttaagtttgctctgaaggcaccaccaaaccaaaacaacttcatttcattggtctttgtcttcctatgtcttttatatttttggtccttgcagtgtttgcttaaacttaagagattggcttgtactcttttaccattgtgtaagaaaaccc

SEQ ID NO: 313 - DNA, 937 bp, Brassica napus
gaagccaccgtcgagtttacttactatctctctctctttcctccgtctcagatttcttctccgttcggaaaactccagtcttcttctctcagaaaaccctaatcttcccgatgtcgatcttcgagtacaatggaagcgccgttgtggctatggttgggaagaactgcttcgccatcgccagtgatcgtagactcggtgtgcagctccagacaatcgccactgatttccagagaatctccaagatccacgatcgcgtcttcatcggcctctctggtctcgccaccgatgtgcaaacactgtaccagcgattggtgtttcgtcataagctgtatcagcttcgtgaagagagagacatgaagcctgagacttttgctagtcttgtctccgccattctttacgagaaaagatttggtccttacttatgccaaccagtgattgctggcttgggagaagatgacaagccctttatttgcaccatggactccattggagccaaggagttagctaaagattttgttgtctctggaactgcttcagaatctctgtatggtgcctgcgaagctatgtacaagccagatatggaagctgaggaactattcgagacaatatcgcaagcacttctgtcgtcagttgaccgtgattgtctgagtggttggggagggcatgtctacgttgtgacaccaacggagattaaagagaggatcctaaagggaaggatggactgatccaatttgccatcatcatctgcttctatccaaaattgttttttcgcgtgtaatccggttttaatcatagaaccattcattctctcaagttatgacttgtggatgaagtttgaatttcccccctctttggattttttttttaattcctagaagttaacgcrtgcactgtactcactggtttctattttaattttatttttaccaaaaaaaat

SEQ ID NO: 314 - DNA, 707 bp, Brassica napus
ccatctctcctccagcttcttcttcttcgtctctgaaactagtttgattcagccatggctaatgcggcgtcaggtatggcagtccatgatgactgcaagctcaagtttctcgaactcaaggctaaaaggactttccgtttcatcgtttacaagatcgaggagcagcagaaacaagtggttgttgagaagctcggcgagcctggtcaatcccatgatgactttgcagctagtcttcctgctgatgaatgccgttacgcagttttcgattttgatttcgtcactgctgagagttgccaaaagagcaagatcttcttcgtcgcatggtctccggacacagcaagagttagaagcaagatgatctacgcgagctccaaggacaggttcaagagagagcttgatggaattcaagtagagcttcaagctaccgatccaactgagatggatctcgatgttttcaaaagccgagccaactgaggaatacatcctccataaaagaattggttgaatccaactttctcctactattactgaattgatatatgcttgttctttaagtttgctctgaaggcaccaccaaaccaaaacaacttcatttcattggtctttgtcttcctatgtcttttatattttttttggtccttgcagtgttttgcttaaaacttaagagatttggcttgtactcttttaccatttgtgtaagaaaaccc

SEQ ID NO: 315 - DNA, 765 bp, Brassica napus
gggcacaccgaagaaagactccatcatctcctccagcttcttcttcttcgtctctgaaactagtttgattcagccatggctaatgcggcgtcaggtatggcagtccatgatgactgcaagctcaagtttctcgaactcaaggctaaaaggactttccgtttcatcgtttacaagatcgaggagcagcagaaacaagtggttgttgagaagctcggcgagcctggtcaatcccatgatgactttgcagcttctcttcctgctgatgaatgccgttacgccgttttcgatttcgatttcgtcactgctgagagttgccagaagagcaagatcttcttcgtcgcatggtctccggacacagcaagagtgagaagcaagatgatctacgcgagctctaaggacaggttcaagagagagcttgacggaattcaagtagagcttcaagctaccgatccaactgagatggatctcgatgttttcaaaagccgagccaactgaggaatacatcctccataaatgaattggttgaatccaaatttctcctactattactgaattgatatatgcttgttctttaagtttgctgtgaaggcaccaccaaaaccaaaacagcttcatttcattggtctctgtcttccctatgtcttttatatttttttttttttggtccttgcagtgttttgcttaaaacttaagagatttggcttgtgctcttttaccatttgtgtaagaaacccccaaacactttaccaaaagatgaatcttatt

SEQ ID NO: 316 - DNA, 822 bp, Brassica napus
accgtcgactttagttataactctctctctctactccgtctcagatttctcttctccgactaaaaaagttccaaactttgctctgcaacaactaatcttccgatgtcgatcttcgagtacaatggcagcgccgtcgtggcaatggtggggaagaactgcttcgccatcgccagtgatcggaggctcggtgtgcagcttcagacaatcgccaccgatttccagagaatctcaaagatccacgatcgtgtcttcatcgccctctctggtctcgccaccgatgtccaaacactgtaccagcgccttgtgttccgtcataagctgtaccagcttcgggaagagagagacatgaagcctgaaactttcgctagtcttgtctccgccattctttacgagaagagatttggtccttacttatgccaaccagtgattgctggattgggagaagatgagaagcccttcatctgcaccatggactctattggtgccaaggagttggctaaagatttcgttgtatctggaactgcttcagaatcactgtatggagcctgtgaagcgatgtacaagccagacatggaagcggaggaactgtttgagacgatttcacaagcacttctgtcatcagttgaccgagattgtctgagtggttggggagggcatgtctacgttgtaacaccaacggagattaaagagaggatcctaaagggaaggatggattaatctgattcatcattatctgcttctatccaagttgttgttttttgttgttgctgtaatctgattttaattagattttaaccatcgtttaatcatattccttctccg

SEQ ID NO: 317 - DNA, 749 bp, Brassica napus
aacgcagaagaaaggaaaagaggagaaaaaaacatctgtcttctctctccgtcacctttcaccagcgttttgatccagcagccatggctaatgcggcttcggggatggcagtccatgatgactgcaagctcaggtttctcgaactcaaggccaagaggactcaccgtttcatcgtttacaagatcgaggagaagcagaagcaagtggttgttgagaaagttggcgaacctattctatcctatgaggatttcgctgctagcctccctgctgaagagtgccgttacgccatttatgatttcgactttgtcactactgagaactgccagaagagcaagattttcttcattgcttggtgtccggatgtagcaaaggtgagaagcaagatgatctacgcgagctccaaggacaggtttaagcgtgagcttgatgggattcaagtggagcttcaggctactgatccaactgagatggatcttgatgttttcaaaagccgcgtcaactaaaaagaataagcttctttggctcatattctatctactattcctgaatggtgttttcttttctctatacagtttcttcttgcaactgtgataaaaacctaactccccttcactctatttccatctggtctgtcttctgtgtctttgttaccatgcagtgttttattttatattgaaaatgtccccgaggtttgtgctgtgtgttggatcctattgtgtaaagatgtttcctttaagcgtttgctctct

SEQ ID NO: 318 - DNA, 735 bp, Brassica napus
aggattatatatagcttccaaataacgccgaacaaaaaggaaaaagaaaagactcatattcgaaaaaagatcttcgtcgtcttctctgcgtctcctttcagcagtctttgacatcgtcttgattcagccatggctaacgcggcgtcgggaatggcagtccatgatgactgcaagctaaggttcctggaactgaaagcgaagaggacgcaccgtttcattgtctacaagatcgaggagaagcagaagcaagtgattgttgagaaagttggtgagcctattcaaacctacgaggactttgctgctagcctccctgctgaagagtgccgatacgccatttatgatttcgactttgtcaccgcggagaattgccagaagagcaagattttcttcattgcatggtgtcctgacgtagcgaaggtgagaagcaagatgatctacgcgagctccaaggacaggttcaagcgtgagcttgatggaattcaagtggagcttcaagcgactgatccaactgagatggatcttgatgttttcaaaagccgggttaattaaaaaacaaatattatctctctctctttgaataagcttctttggctcttacagtttcctgtgactgttataaaaacataacgctcttttattctatcttatctggtcctgtgttctgcgtcgttgttaccgaacagtgttttcgtcttatattgaaagtttatcccaatgtttgtgctgtttgtttac

SEQ ID NO: 319 - DNA, 690 bp, Brassica napus
ggaaaaagaaagactcatattcgaaaaaagatcttcgtcttctctgcgtctcctttcagcagtctttgacatcgtcttgattcagccatggctaacgcggcgtcgggaatggcagtccatgatgactgcaagctaaggttcctggaactgaaggcgaagaggacgcaccgtttcattgtttacaagatcgaggagaagcagaagcaagtgattgttgagaaagttggtgagcctattcaaacctacgaggactttgctgcgagcctcccagctgaagagtgccgatacgccatttatgacttcgactttgtcactgcggagaattgccagaagagcaagattttcttcattgcgtggtgtcctgacgtagcaaaggtgagaagcaagatgatctatgcgagctccaaggacaggttcaagcgtgagcttgatggaattcaagtggagcttcaagcgactgatccaactgagatggatcttgatgttttcaaaagccgtgtcaattaaaaaacaaatattctctctctctctctctctctttgaataagcttctttggctcttacagtttcctgcgactgtataaaaacataacgccctttattctatccttatctggtctcgtcttctgcgtcgttgttaccgaacagtgttttcatcttatattgaaagttatcccaacgtttgtgctg

SEQ ID NO: 320 - DNA, 745 bp, Brassica napus
ctctctctctctctctactccgtctcagatttatcttctccgctcggaaaagctccagactttgctctgcaaaccctaatcttccgatgtcgatcttcgagtacaatggaagcgccgtcgtggcaatggtggggaagaactgcttcgccatcgctagtgatcggaggctcggtgtgcagctacagacaatcgccaccgatttccagagaatctcaaagatccacgatcgtgtcttcatcgccctctctggtctcgccacggatgtccaaacactgtaccagcgccttgtgttccgtcataagctgtaccagcttcgggaagagagagacatgaagcctgaaactttcgccagtcttgtctccgccattctttacgagaagagatttggaccttacttatgccaaccagtgattgctggattgggagaagatgacaagcccttcatctgcaccatggactccattggtgccaaggagttggctaaagatttcgttgtatctggaactgcttcagaatcactgtatggggcctgcgaagcaatgtacaagccagacatggaagccgaggaactgtttgagacgatttcacaagcacttctctcctcagttgaccgagattgtctgagtggttggggagggcatgtctacgttgtaacaccaacggagattaaagagaggatcctaaagggaaggatggattaatctgcttctatccmagtgttgtttttctgttgttgctgtaatct

SEQ ID NO: 321 - DNA, 925 bp, Brassica napus
gaattcgaccagctagaaaagacgaaagtcttaccctagtagttgtttctttaaagtctccgtctttctgtcgaaatctgagaacttttatttgaatccaaagagagaaaaaaaaaaacgaaagcttgttttggtatcgtgttgaatggcgggttacaaagcagatgatgattacgattacttattcaaggtggttttaatcggcgattcaggtgttggaaaatccaatctgctttctcgattcaccaggaacgagtttagcctcgagtccaagtccaccatcggcgtcgagttcgccactcgtagcttgactgttaaggacaaagtcatcaaagcccagatttgggatactgctggtcaagaaaggtaccgagcaatcactagtgcatactacagaggagctgttggkgcycttctygtctacgacgtaacccgacactccacgttcgaaaacgttgagagatggcttagggagcttcgtgaccataccgacccaaacatagttgtcatgctcgtgggaaacaaatctgatcttcgtcatcttattgcggttcagaccgaagatgctaagtctttygcggagaaygaatcactctacttcatggaracttcagctctygagtctactaacgttgagaacgcgttttckgaagtgctcactcagattcaccaagttgtgagcaagaaagcratggaggctggtgatgattcgggtaatgttccttctaaaggagagaagattgatattgatgtatcggctgtgaagaaaactggttgctgctcgaactaaaagactcgtttagtctcttgcagattgttatggatttggtctgtttcctcaaagctatgatcgttcttyytttatacattcaaaattcttttgaagatgtctgcttttttattattagggaaacaatctatgtta

SEQ ID NO: 322 - DNA, 713 bp, Brassica napus
gattcaacgaagtattgattggtgattcagatcttcgagtacaacggaagtgccgtggtggctatggtaggcaagaactgcttcgctatagcaagtgatcgaaggctcggtgtgcagttacagaccatcgctacggatttcaagagaatctcgaagatccacgatcgtctcttcatcggcctttccggtctcgccactgatgtccagacactgtaccagagactcgtgtttcgtcataagttgtatcagcttcgggaagagagagacatgaagcctgagactttcgctagtcttgtctccgccattctttatgagaaaaggtttggtccatacttgtgccaacctgtgattgctggatttggagaagatgataaacctttcatttgcactatggattccattggagccaaggagttggctaaagattttgttgtgtctggaactgcttcagaatcactatatggtgcctgtgaagccatgtacaaaccagatatggaagctgaggaattgtttgagacaatttcacaagcacttctctcttcagttgaccgcgattgtctgagtggttggggaggacatgtctacgttgtaacaccaaatgaaatcaaggagagaatcctcaagggaaggatggattgatttaaaaatcacgtatctgctgttgtccaatttcgtttctggtttaagtagaagaaacctctcggtcacatagt

SEQ ID NO: 323 - DNA, 824 bp, Brassica napus
ctccgcttgatatttttcaattccgcgtctctctctctctctctctctctctcggtagaagtcgaaaagatctagagaacaaaatcctggcgtaaatctcgttagggcttttcaatttttgaaaaaagcgcaaaaaacattttgatctctctctcttttttcaatggcgggttacaaagcagatgatgaatacgattaccttttcaaggttgttctaatcggtgattctggtgttgggaagtccaatctgctttcacgattcacgaagaacgagtttagcctcgagtccaaatcaaccatcggtgtcgagttcgcgactaggagcttgaatgttgatgataaagtcatcaaagcccagatttgggatactgctggtcaagaaaggtaccgagccatcaccagcgcgtattatcgaggagccgttggagcacttcttgtctacgacgtaacccgacactcgacatttgaaaacgtggagacgtggctcaaagaactcagaaaccacaccgatccaaacatcgtagtcatgctcgtcggcaacaaatccgatctccgccacctcgtggctgttcagacagacgatgccaagtcgttcgctgagaaagagtctctttacttcatggaaacctcggctctcgactccaccaatgtcgagaacgctttcgcggaagtcctcactcagattcactgcattgtgagcagaaaggccatggaagctgcgagcgaatctgctaatgttccgtcgaaaggagacaagatcgatcttggtaaagatgtttcggcagtgaagaaaggtggatgctgctcaaactaataacagagtg

SEQ ID NO: 324 - DNA, 768 bp, Brassica napus
gaaaccaccgtcgactttacttactctctctctctctctcctccgtctgagatttcttcttcgttcggaaagctccaatctttttctctcagaaaaccctaatcttcacgatgtygatcttcgagtacaatggaagtgccgttgtggctatggttgggaagaactgtttcgccatcgccagtgatcgtaggctcggtgtgcagctccagacaatcgccactgacttccagagaatctccaagatccacgatcgcgtcttcatcggcctctctggtctcgccaccgatgtccaaacactgtaccagcgcttggtgtttcgtcataagctctaccagcttcgtgaagagagagacatgaagcctgagactttcgctagtcttgtctccgccattctttacgagaaaagatttggtccttacttatgccaaccagttattgctggcttgggagaagatgacaagccctttatttgcaccatggactccattggagccaaggagttagctaaagattttgttgtctctggaactgcttcagaatctcygtatggtgcctgcgaagctatgtacaagccagatatggaagctgaggaactattcgagacaatatcgcaagcacttctgtcgtcagttgaccgtgattgtctgagtggttggggagggcatgtctacgttgtgacaccaactgagattaaagagaggatcctaaagggaaggatggactgatccaatttgccatcatcatctgcttctatccaaagttgttttt

SEQ ID NO: 325 - DNA, 811 bp, Brassica napus
gggggggaacaggaagagaaaagaaaagacgcacgcacaccgtagtctccatcgtctctccagcttcttcttcttcgtctctgaaactaatctgattcagccatggctaatgcagcgtcaggcatggcagtccacgatgactgcaagctcaagtttcttgaacttaaggcgaagaggacataccgtttcatcgtttacaagatcgaggagcagcagaagcaagtggttgttgagaaactaggcgagcctggtcaatcccatgatgactttgcagcaagtcttccagctgatgagtgccgctacgccatcttcgattttgatttcgtcactgctgagaactgtcagaagagcaagattttcttcatcgcatggtctccggacacagcaagagttagaagcaagatgatctatgcgagctctaaggacaggttcaagagagagctagacgggattcaagtagagcttcaagcgaccgatccaactgagatggatctcgacattttcaaaagccgagccaattgaggaacggttgtatcaaactttgttgcttctgttaccagagtcatatgctttatcctaaagtttgctgtgacggcaccaaccaaaacagcttcatttgatcggtctttctcttcagtgtctttttttttgggttcttacagtgtcttgcttaaaacttaaagagatttggcctgtgctcttttataatcgtgtaagaaacccaaaccgtttatcaacagatgatcctattggaacattgtctctcatctacatgagatgcctagtgatccagggattaaacaaaataata

SEQ ID NO: 326 - DNA, 935 bp, Ricinus communis
gaaaaaaatttaaaattgaaaaaaagagagtctgttttccattattcaagtctctattagaaggagtaaagaaaaagcttgaataatatcaatctctctcccctctctctatctgtagttatatatagatactgcttatacaaatatctcaagtttcttttatttttttttttcccttttcttgggtagcttcttgatctttataactatggctaatgctgcatctggaatggctgtgcacgacgactgcaagctaaggttcttggagctgaaggcaaaaagaacttatcgcttcattgtttttaagatcgaggagaagcaaaagcaggttattgtggaaaaggttggtgagccagcccaaagctacgaagattttactgcaagccttcctgctgatgagtgtcgatacgcggtttatgatttcgacttcgtgactgcagagaattgtcaaaagagcaggattttctttattgcatggtctcccgacacatcaagggtgagaagcaagatgatctatgcaagttctaaggacaggttcaagagagaattagatggtatccagatagagttgcaggcaactgatcctactgagatgggtcttgatgtctttagaagccgtgccaactgaatacaaggctcctaaatttcacaatggagagtttcgtatccactctactcttaaatgcaaaatgtttgtagttcatgggctgtgaacctgactgaattatgatgttggtttgtggtttgagtttcaacttatagtcttcttcttgaacaggtctgatgattttgattatattgttacaatttgttatgtactgaacttatgcaaggtgtgtgttctttatagttatgttcacaatatgtgatgtatcggaatctgatggtaggagcaaactgggatttgtagtttggaatatgaaaatggatgtttt

SEQ ID NO: 327 - DNA, 3041 bp, Ricinus communis
ctgttctctccctttcctttctttctcacatagctcgatctacccaaccatagcgaagaacaaacagaatacacaaactctcttaggtaccgtctctgtcattatcttctgctcatcgaaccacaaatagagatgaaagacagtaaagatggtgataaaatttcaaaatctgcatctgttggttcccttccactgattctggatatcgacgactttaagggcgagttttcttttgatgcattatttggcaacttggtaaatgaactgcttccctctttccaagaagaagaagcagattcagcagaagggcatggaaacattggtgggagcgatgtgttagcaaatgggcatgtaagagccccctctgatgccataaaattttcacaaggacaatctcctttatttccagaagtagattctctcttgtccttgtttagggattcttgtagagagctgatcgatcttcgaaaacaggttgatggaaagctctcaaatctgaggaaggatgtttccgtccaagattctaagcaccgcaaaacacttgctgagctggaaaaaggcgtagatgggctgtttgatagctttgcaaggttggactcacgtatttcaagtgttggacagactgctgcaaaaattggagatcatttgcagagtgcagatgcgcagagggaaacggccggccaaacaatagagctcataaagtacttgatggagtttaatggcagtccgggcgatttaatggaactgtcgcctttgttttcagatgacagccgtgttgctgaggctgctacaattgcacagaaattacgttcctttgctgaggaagacataggacggcaaggaatgtctgtagcatcagatatgggaaatgcaactgccagcagaggattagaagttgcagttgctaatcttcaggattactgcaatgaactggagaatagattgttggctcggtttgacgcatcatcacagagaagagaattgtctaccatggcagaatgtgctaaaattttatctcggttcaacaggggcacgagtgctatgcaacattacgtggcaacacgtccaatgtttattgatgtggaagtcatgaatgcagacaccagattggttcttggcgatcaggtttcacaagctagtcccagcagtgttgctcgtgggctatcttcattgtacaaagaaattacagatactgttcgtaaagaggcagccacaattacggcagtatttccttctcctaatgatgtcatgtccattttagtgcagcgagttttggagcagcgagttacagctcttttggataagttgttagtgaaaccatctcttgtgaatttacctccaatggaagaaggcggacttctattatatcttagaatgttagcagtggcatatgaaaagactcaggaacttgctagagacctacgagctgttggatgtggtgacttggatgttgagggtctcacggaatctctgttttcttctcacaaggatgactatcctgaacatgaacaaacctctcttagacagctatatcgcgcaaagatggaagaattacgtgctgagagtcagcagctctctgagtcaactgggacaatagggcgatcaaaaggagcttctgtagcatcttcccatcaacagatatctgttactgttgtgacagaatttgtgcgttggaatgaagaagcaatatccagatgcactctattttcatctcaacctactatccttgcagcaaatgtaaaaccggtgttcacttgcttgctagaccaagttgggcaatatataactgaaggtcttgaacgagctagagacagcctgactgaagctgcagctttgagggaaaggtttgttctgggaacaaaccttagtagaagggtggctgctgcagctgcttctgctgcagaagctgctgctgctgctggtgagagcagtttccgttctttcatggttgctgtacaacggtgtggcagtagtgtggctatagttcagcaatgttttgcaaattctatatctcggcttttactacctgtggatggggctcatgctgcttcatgtgaagaaatggcaacagctatgtccagtgcggaaagtgctgcttataaagggcttcaacagtgtattgaaactgttatggctgaggtagagcgactgctatcagctgaacagaaggcaacagattataggtcacctgatgatggaattgctcctgatcatcgaccaacaagtgcttgcacaagagttgtggcatatctttctcgtgtgctcgagacagcattcactgcattagaaggtcttaacaaacaagcgttcctaactgaattggggaatcgcttacataaagggctacttaatcattggcagaaattcacttttaaccccagtgggggactgcggctgaaacgtgacataactgagtatggagaatttgtgcggagttttaatgctccttctgttgatgaaaaatttgaattattgggcataatggctaatgtatttattgtagctcctgaaagcctctccactttgtttgagggtaccccgagcatccgtaaagacgcacaaaggtttattcagcttagagaggactacaagagtgcaaaacttgcatccaagcttaactctttgtggacaagttgataaagaaatggcatgctgacatatgtagcttctcatattctttggttttcttgcaccgagatggatattttacttccagctattatgacagtgggaactggctcaagattaattgttctgttagcttttagaccatgttagagatatgttccgagatcaactgtattcaaaggcatggagcctcccttggatagtcaatcgggtagaaagttctgtttgatttttttttcctgaacctcttcttttttcatttttctattgtaaatttcaagctattgatggcaagatgtgatagatttgtttcttgatgctcttttttagaatttaggtttgcagttttgattagacaattccagggaagaatctgttgtcctctgtattcttgtaaatgatatacttaggga

SEQ ID NO: 328 - DNA, 3009 bp, Ricinus communis
ctgttctctccctttcctttctttctcacatagctcgatctacccaaccatagcgaagaacaaacagaatacacaaactctcttaggtaccgtctctgtcattatcttctgctcatcgaaccacaaatagagatgaaagacagtaaagatggtgataaaatttcaaaatctgcatctgttggttcccttccactgattctggatatcgacgactttaagggcgagttttcttttgatgcattatttggcaacttggtaaatgaactgcttccctctttccaagaagaagaagcagattcagcagaagggcatggaaacattggtgggagcgatgtgttagcaaatgggcatgtaagagccccctctgatgccataaaattttcacaaggacaatctcctttatttccagaagtagattctctcttgtccttgtttagggattcttgtagagagctgatcgatcttcgaaaacaggttgatggaaagctctcaaatctgaggaaggatgtttccgtccaagattctaagcaccgcaaaacacttgctgagctggaaaaaggcgtagatgggctgtttgatagctttgcaaggttggactcacgtatttcaagtgttggacagactgctgcaaaaattggagatcatttgcagagtgcagatgcgcagagggaaacggccggccaaacaatagagctcataaagtacttgatggagtttaatggcagtccgggcgatttaatggaactgtcgcctttgttttcagatgacagccgtgttgctgaggctgctacaattgcacagaaattacgttcctttgctgaggaagacataggacggcaaggaatgtctgtagcatcagatatgggaaatgcaactgccagcagaggattagaagttgcagttgctaatcttcaggattactgcaatgaactggagaatagattgttggctcggtttgacgcatcatcacagagaagagaattgtctaccatggcagaatgtgctaaaattttatctcggttcaacaggggcacgagtgctatgcaacattacgtggcaacacgtccaatgtttattgatgtggaagtcatgaatgcagacaccagattggttcttggcgatcaggtttcacaagctagtcccagcagtgttgctcgtgggctatcttcattgtacaaagaaattacagatactgttcgtaaagaggcagccacaattacggcagtatttccttctcctaatgatgtcatgtccattttagtgcagcgagttttggagcagcgagttacagctcttttggataagttgttagtgaaaccatctcttgtgaatttacctccaatggaagaaggcggacttctattatatcttagaatgttagcagtggcatatgaaaagactcaggaacttgctagagacctacgagctgttggatgtggtgacttggatgttgagggatgactatcctgaacatgaacaaacctctcttagacagctatatcgcgcaaagatggaagaattacgtgctgagagtcagcagctctctgagtcaactgggacaatagggcgatcaaaaggagcttctgtagcatcttcccatcaacagatatctgttactgttgtgacagaatttgtgcgttggaatgaagaagcaatatccagatgcactctattttcatctcaacctactatccttgcagcaaatgtaaaaccggtgttcacttgcttgctagaccaagttgggcaatatataactgaaggtcttgaacgagctagagacagcctgactgaagctgcagctttgagggaaaggtttgttctgggaacaaaccttagtagaagggtggctgctgcagctgcttctgctgcagaagctgctgctgctgctggtgagagcagtttccgttctttcatggttgctgtacaacggtgtggcagtagtgtggctatagttcagcaatgttttgcaaattctatatctcggcttttactacctgtggatggggctcatgctgcttcatgtgaagaaatggcaacagctatgtccagtgcggaaagtgctgcttataaagggcttcaacagtgtattgaaactgttatggctgaggtagagcgactgctatcagctgaacagaaggcaacagattataggtcacctgatgatggaattgctcctgatcatcgaccaacaagtgcttgcacaagagttgtggcatatctttctcgtgtgctcgagacagcattcactgcattagaaggtcttaacaaacaagcgttcctaactgaattggggaatcgcttacataaagggctacttaatcattggcagaaattcacttttaaccccagtgggggactgcggctgaaacgtgacataactgagtatggagaatttgtgcggagttttaatgctccttctgttgatgaaaaatttgaattattgggcataatggctaatgtatttattgtagctcctgaaagcctctccactttgtttgagggtaccccgagcatccgtaaagacgcacaaaggtttattcagcttagagaggactacaagagtgcaaaacttgcatccaagcttaactctttgtggacaagttgataaagaaatggcatgctgacatatgtagcttctcatattctttggttttcttgcaccgagatggatattttacttccagctattatgacagtgggaactggctcaagattaattgttctgttagcttttagaccatgttagagatatgttccgagatcaactgtattcaaaggcatggagcctcccttggatagtcaatcgggtagaaagttctgtttgatttttttttcctgaacctcttcttttttcatttttctattgtaaatttcaagctattgatggcaagatgtgatagatttgtttcttgatgctcttttttagaatttaggtttgcagttttgattagacaattccagggaagaatctgttgtcctctgtattcttgtaaatgatatacttaggga

SEQ ID NO: 329 - DNA, 840 bp, Ricinus communis
gatcttcgagtacaatggaagtgccctaatagcaatggttgggaagaactgctttgcaatagctagcgatcggagactcggtgttcagctccaaacaatcgccactgatttccagagaatctacaaaattcatgatcgtctctttttaggtctttctggccttgccaccgatgctcaaactctctaccagaggttagttttccgtcacaaattgtaccagttgcgagaagagagagatatgaatcctgagacttttgctagccttgtctccgctcttctttatgagaaaaggttcggtccatacttctgtcagcctgtaattgctggattgagtgatgaaaacaagccttttatctgcactatggattcaattggtgccaaggaactcgccagagattttgttgttgctggcacagcctcagagtcactttatggtgcttgtgaatcaatgttcaagcctgatttggaagctgaagaattgacagaaataatatctcaagcactgctttcatcagtagatcgggactgtttgagtggttggggtggacatgtctatgttgttactcccacagaagttacagaaagaatcttgaaaggaaggatggattgatcttttatttacgaagctgaaggccgaagcccttctacactcaagattagatcaccagtttgtcagtgtattcagccttagactcaaatttgaatgcgaaccgtctggtttctttaatgaaggctgttgttctgtaacttaaaaatcaaagcacacacttgataagattttcaacttcaagcttgagttctggtgtattgaatgcagcttctagtgctaagtttgacttt

SEQ ID NO: 330 - DNA, 921 bp, Ricinus communis
cagctcactcccctagcaaaagggtcaaaagaacacattactatattaaagcttttggattcgaacttctcttactttgtttgaaagcaagaaataagagaagtgaaaaatggcagggtatagagcagaagatgactacgattacctattcaaggtggtcctgatcggtgattcaggtgtaggcaagtctaatctgctttctaggtttactcgtaatgagtttagcttggagtctaagtccactattggagttgagttcgctactcgtagcttaaacgtcgatggcaaggttatcaaggcccagatttgggatactgctggtcaagaaaggtaccgtgccattactagtgcatactaccgaggagcagtaggtgccctgcttgtctacgatgtcacccgccactcaacatttgaaaacgtcgaaaggtggttaagggaattgagggaccacacagatcccaacattgtggtcatgctcataggcaacaaatcagatcttcgccaccttgtggctgtctcaactgaggatggcaagtcatttgccgagagggagtctctctacttcatggaaacttctgctctggaagctactaatgtagacaatgcatttgctgaagtgcttacacagatctaccgaattgtaagcaagaaggctatggagactggcgatgaaggtgctgcctcggctgttccttccaagggagagaaaattgatgtcagtaaagatgtttctgcaatgaagagagtaggatgctgctctagctaggagtttagtcagaattgacgcagaggatggagccagtttgttttgctgcatctatctttatgtacaccattattgtgtaaaattttcttaaagatgccaacagtaggagaggtggggattgatttttaaagttttcttttccatcgactgctatt

SEQ ID NO: 331 - DNA, 1102 bp, Ricinus communis
ggttccgcatggccctgagcaatggggaaatgagtttgctgctgaaagagggcaaaatggctctgttgatgatcagtgggtaaatgaattctcaaagttgcatgttaatgactgggtagaagaatttgggcaacaggttgaggaaggagcattaggggacagttcagtggataactgggcaaatgcatatgacgagtacatgaatgaacaagtagctgctaagcagcagtcagatgcttcaaggggagtctatgtgttttctgatatgaatccttatgttggtcaccccaatcctttaaaacaaggccaggatctattccataaagggcttctaagtgaatcagtgcttgctttagaggctgaagtcttgaaaaatcccgataatgctgaaggttggaggttacttggaatagcaaatgcagagaatgacgatgatcaacaggctattgcagcaatgatgcgtgcgcaggaggctgatcctgcaaatcttgaagtgcttcttgctcttggtgtgagtcatacaaatgaattggagcaggcagctgccttgaaatacttatatggatggcttcgtaatcacccgaaatatggatcacttgcctctccagagcttgctgattcgttgtattatgctgatgttgctagattattcaatgatgcttctcagatgtcacctgaggatgctgacgtgcacatcgtacttggcgtgctatataatttatccagggaatatgacaaagccattgcttcctttcaaacagctttgaaacttaagccacaggattactccctctggaacaagcttggtgcaacccaggcaaacagtgttcagagtgctgatgcaatatatgcctaccagcaggcacttgatttgaagcctaattatgttcgtgcatgggcaaacatgggaatcagttatgccaatcagggtatgtacgaggactccatccgctattatgtccgggcacttgctatgaaccctaaggcagataatgcctggcaatatttgaggatttcactaagctgtgcttctaggaatgacatgctagaggcttgtgattcacgcaatattgatcttctgcagaaagagtttccactgtaa

SEQ ID NO: 332 - DNA, 651 bp, Ricinus communis
atgggggcttatagagcagatgatgattatgattacttgtttaaggttgttttaataggtgattctggtgttgggaaatcaaatctgttgtctagattcacaaggaatgaattcagcttggaatccaaatccaccattggtgttgaatttgctactcgtagtatccatgttgatgacaaggttgttaaggcccagatttgggacactgctggtcaggaaagatatcgtgcaatcactagtgcatactacagaggagctgttggtgccttgcttgtctatgatgtcactagacatgttacctttgagaacgtggaaagatggttgaaggagcttcgagatcacactgattccaacattgttattatgcttgtgggaaacaaggcagatttgcgtcacttacgtgcagttacaactgaggatgccaaggcatttgctgagagagagagcaccttctttatggaaacctctgcgctagaatccttgaatgtcgaaaatgcctttactgaagtgctaactcagatctatcgtgttgtcagccggaaggctcttgatgtaggggatgaccctgcagccttgcctaagggacagactattaatgttggcaaagatgatgtatcagctgtgaaaaaagttggatgctgctcagcatag

SEQ ID NO: 333 - DNA, 757 bp, Ricinus communis
catcgcattttcaaaaattaaaaggaaaaaagtctatctttatcacccccttctttctctctctcttaaccctagattctctctctatctctctctatctctctctatctgccgttatattttttttttctcgagaaaatggcaaacgcagcgtctgggatggctgtgcatgatgactgcaaactgaagttcttagaattgaaggctaaaaggagccaccgcttcattgttttcaagattgaaatggtgcagaagcaggtcgttgtggagaagctaggtcaaccaaccgacagttatgaggattttgctgcaagcctccctgctgatgaatgccgatatgctgtctatgactttgattatgtgacggatgagaactgtcagaagagtaggatcgtttttattgcatggtctcctgatacggccaaggtgagaaacaagatgatttatgctagctcgaaggacaggttcaagagagagttagatggcattcaggtagagctgcaagctaccgatccaactgagatgggtcttgatgttattagaagccgatcaaattgaatattaagtacctaaaatgcgatgtggagagcctatatgatgtggttcattaaagtctactgtttataaaatttgaacctagaagttgcttctcaaagtgttgtctttattatatctgtggattcatggggtggttatccccttctagcgtgatgattacgcacaatttatatgatggtttgtggtggtatagtttctc

SEQ ID NO: 334 - DNA, 669 bp, prunus avium
cggaggagagacccttccctatatcttctcctccttcttcgtcgccaacaaaacccaaacaacgagaaaagatggccaacgcagcatctggtatggctgtgcatgatgattgcaaattgaagtttttggagcttaaggccaagaggacctaccgctcaattgttttcaaaattgaggagaagcaaaagcaagttgtggtggaatctgttggtgaaccaacagagacctatgagcagtttgccgaaaaacttcccgctgatgaatgccgttatgctgtttttgattttgatttccttacaccagaaggtgtccagaagagccgcatattcttcattgcatggtctcctgatacatcaagggtgagaagcaagatgatctatgcaagctcgaaagacagatttaagagagagcttgatggaatccagattgagttgcaagcgactgatccgactgagattggtcttgatgtgattaaaagccgtgccagctagataatcataggctatttggttgggagagttcttcccttcagccttttgttacttgcgtggaatgtttatacattgtgggatggcgacttggcaatgatggcatgaatttccaagtttcgccattgtttcttattcgttttgaacaagtgtctgtggtttccggtatatcatatgatat

SEQ ID NO: 335 - DNA, 1377 bp, Citrus sinensis
ggggagtcaccagtcagatttttcataatattaaaaaagcaaagcaaaaagaaaatttgagaaaaaaaaccagaataaaaacaatataaaacaagtagaagagagtccttcattatcttaacctccatttcctctccaacaaactttccttcaccttgcaaaatttctctgtactttgcttcttagatcttgatcctagaaaccatggctaatgctgcttctgggatggctgtacatgatgactgtaagctaaagttcttggagttgaaagccaagagaacctaccgcttcatagtatttaagattgaggagaagcagaagcaggtcattgtggaaaaacttggtgagccaactcaaacctatgaagattttgctgccagccttcctgctgaggagtgccgatatgctgtgtatgattatgattttgttaccgcagagaactgccaaaaaagcaggattttcttcattgcatggtctcccgacactgcaagagtaagaagcaagatgatttatgcaagctccaaggacaggttcaagagagagctagatggcattcaagtggagctgcaggcaactgatccatctgagatgggtcttgacgtatttaaagaccgtgccaactaaataaaggctcctgatctcagcaattgagattgtttttatcttttgtgctttacctaaaggtgaaatgttaatagtttgtggcggcagcttgaatctaactgaattatgatattggtttgttgttcaagtttcaccgatgcagtattctcgtctagaaccatttcagtggtctttatgatgtctttattgatttgttgtggtgtggaagttatgggatgagtggctacttatagctatttcgtcaagctaaggtgtttcaattgatgggggatggataaccctctgttagggttgtttttactttgaaaatggatgtttcattttgaactttataaatggatgtttcattttaaaaaaaaaaaaaaaaaaaatcccaagggggggccgcggcccaaattgcccttatagtcaacctaataacatttcaactggcccctttttacaagttcagcccggggaaaaccggacattcccccctttaatccctttaaccccatccccccttcgccccttgcccatataacggaaaaacccaccacgtcccccccctcccaccattcccaaaccaggaaaaccgaaggagaaattttgagccgattaatatttttaaaattttttgttataaatttttgtttaaatatctctcactttttcatcatttattcccacaataacgcccaaaatatccctcaaaaataaccccaaaaagaaaaataaacaaaaagaaaaaagagagagcaggaaaaaatggtg

SEQ ID NO: 336 - DNA, 1101 bp, Citrus sinensis
ggggctactccaagccatcaacatttgtcataaaagaagttggcggtctcaaaattttgttaaatcgttttgttgccaactgaactgaactcgcatcaagtcactctacaattataattatgtctatcactgagtacaatgggagcgcactcgttgcgatggtcggaaagaactgctttgccattgccagcgatcggcgcctcggcgttcagcttcagacaatagccactgattttcagcgaatttccaaaattcacgatcgcctttttatcggcctctctggactcgccactgattcccagaccttgtatcaaaggctggtgtttcgtcacaaattgtatcagctgcgagaggaaagggacatgaagcctgaaacttttgctagcttagtctctgctttgctttatgagaaaaggtttggcccttacttctgtcaacctgttattgctggattgagtgatgaagacaagccctttatctgcacaatggactcaattggagccaaggagcttgcaaaagattttgttgttgctggaactgctggagagtctctttatggtgcctgtgaggcaatgttcaagcctgatatggaacccgatgagttgtttgaaactgtatctcaagctttgttatcatctgttgaccgtgactgtttgagtggttggggaggacatgtctacattgtaacaccaactgaaataaaggaaagaatcttgaagggaaggatggattgatctataactgcagtgctgaaagccaccccttctgttgcgttcactcttcagtattttttaattagaagaccgtagacttgaacttgacttttatttgtttatgaagaatgttgtttaagagctctcaaattgttgtactctgaaatagtttcaaactgaattgaccaagttcgtgggcttgcggttatctggatggatgaaagtgtttctatcaattgaggttttgatcttttgcgcttgctatatagtgcttgtttggggttgtcaaacaactgaaaatatgctgggtaaagcattttagaacagattactgtatttgaaaattggatactctaataaagctttttacaatagcatttgaaaatca

SEQ ID NO: 337 - DNA, 868 bp, Citrus sinensis
atcagccgcatctgtccttctctctctttctcactatagaatccctagattttctctcaatttccctcattttctctcccctttttttctccagaaaatggcaaatgcagcatctggaatggcagtcgacgatgactgcaagctgaagtttttggaattgaaggcaaaaaggacttaccgcttcatagttttcaagattgaagagaagcagaagcaggttgttgtggagaagcttggtgaaccatctgatagttatgagaatttcactgctagcctcccagcggatgagtgccgatacgctgtctacgattttgactttgtgactgatgagaactgccagaagagcaagattattttcattgcatggtcccccgacacctcaaaggtgagaagcaagatgatttatgctagctccaaggacaggttcaagagagaattggatggaattcaggtagagttgcaggctactgatcctactgagatgggtcttgatgtcatgagaagccgcacaaattaaattttagacttgcctatggtgcaatggaaagcccatactatattgttcacttaaatgtaatgtctatatcttttatgacttataacttgctttgctatcagcttgtggtcggagttaaatacttttttaagttgtcttctcatttgttatatctgtggattaatagggtgagtatccccatatggtgtgatgataattacagactaatatataatggtttgtggggggtacatatctcattttagctttgattgcttgcaactgggttatttgcagtagtatcagtgtaatacatcagttacatgatttgttatggatgcaatttcttacatgagttagtatttttcccta

SEQ ID NO: 338 - DNA, 1117 bp, Citrus sinensis
tgaggcagtcacgcagatctattaaatttaaaactctctctcaaagactcaaaacaagaagagaatagtccaagagagtgtgaagatataargttgcaatagctatggctggatacagagctgaagatgactatgattatctttttaaggtggttttgatcggtgactccggtgtcggcaagtccaatttgctttctaggttcactaggaacgagtttagtctcgagtctaagtccacaataggtgttgagttcgctactcgtagcttgaatgtcgatggcaaagtcatcaaagctcagatttgggacaccgccggccaagaaaggtaccgtgccataaccagtgcatactaccgaggagctgtcggggcacttctagtgtatgacgtcactcggcattccacatttgaaaatgtggaaaggtggttaagggagttgagggatcacacagatcccaacattgtggttatgctcattggtaataaatcggatctccgtcacctggtggctgtctcaacggaggacgggaaatcatttgctgagaaggaatctctcttcttcatggaaacttctgctctggaggctactaatgtggacaatgcatttgctgaagtgctgactcaaatctaccgtattgtgagcaagaaggccatggagacaggtgaggatggaggaaattctgctgtaccttccaaaggagagaaaattgatgtcagtaaagatgtgtctgctgtgaagaaaggtggctgctgctcaacatagtgggttgatatatttttaacggacgaagcggctatatgttaggctctgtctgttttctcttctccgttattgtgtaaaattttctgaaaagtggcctacagtaggagataggcggtgattaatttctctttcagattcaaaatttttcccggtgactcttgtttttggctggctgactaggagtttatgtaggaacaatgaattacatacttaggtattgagtgggaacaaatttgcactgagaaattgtttatcgagagattyttgttcgcatctagaatcctatttcagtattgtgcatcctatttttcattaagaacatgattaagcaagtgtcacctggaaaaatatcctta

SEQ ID NO: 339 - DNA, 3017 bp, Citrus sinensis
ctgcaggcacctgggctcgatctactacccaaccgaagcytycagaaaaacgcaaaaggcctgtatatcgtacccctctctctgctgtctcgctccttcactcgccgaagagatgaaagagagtcgagatggaatcggtcatgatagaatttcaaaatcgtcatcggttagctctattccactcattcttgacatagatgacttcaagggtgatttttcttttgatgcactatttgggaacttggtgaatgagcttctgccctcttttcaagaagaagaagctgattcagctgatggacatggtaacgttagcgggaatgatactttgccaaacgggcacaaacgggcctcatcagatgcaataaagttcacacaaggattggccgcccctttatttccagaagtggatgctctctcatctctgttcaaggattcttgtagggagctgatagatcttcgtaaacagattgatgacagactcttcaatctcaagaaagagctttctgtccaagattctaaacaccgcaagacacttgctgagctagaaaaaggtgtggacggcttgtttgatagttttgcaagattagattcacgtatatcaagtgttggacagactgctgccaaaataggagatcatttgcagagtgcagatgctcagcgggtaactgctagtcaaactattgacctcataaagtacttgatggagtttaacagcagcccaggtgacctaatggaactttcacctttattttctgacgacagccgtgttgctgaggctgcttcaattgcagagaaattgcgatcatttgctgaggaagatattggaagacaaggcatacaagatatgggaaatgcaaatgctagcagaggactagaagttgctgtagctaatcttcaggattactgcaatgaactggagaacagattgttatctcggtttgatgccgcatcacaaagaagagaactgtctaccatgtcagaatgtgctaaaattttatctcagtttaacaggggtactagtgccatgcaacattatgtggcaacacgtcctatgttcattgatgtggaagtcatgaatgccgatgtcagactagttctaggcgatcagggttctcaagctagtcccagcaatgttgctcgaggacttgcttccttgtacaaagaaataacagatactgtgcggaaagaagcagcaacaattactgcagttttcccttctcctaattatgtcatgagtattctagttcagcgagttttggagcagcgggttacagccattctggacaaactattagtgaaaccatctcttgtgaatctacctccaatggaagaaggcggactcctattatatcttagaatgcttgccgttgcttatgagaagacacaggaacttgctagagacctacgaaccgtgggatgtggtgatttggatattgagggtgtcacagaatgtctttttacttctcacaaggaggaatatcctgaacatgaacaggcttctcttagacaactatatcaagctaagatggaagaattgcgttctgaaagccagcaactttctgagtcatcagggacaattgggcgctctaaaggagcttctgtagcttcttctccccagcagatatctgttacagttgtgacagagtttgtgcgttggaatgaagaagcgttatcaagatgcactttattttcatctcaacctgctgcccttgctgccaatgtgagagcagtgtttacttgcctgctagaccaagtcagtcaatatataacagaggggcttgaaagggctagggacagcctcactgaagctgcagcactgagggaaaggtttgtgctgggcacaagtgttagtagaagggtggctgctgcggctgcatctgctgcagaagcagctgctgctgctggggaaagcagtttcagatctttcatggttgcagtacaacgttgcggtagtagtgtcgctatagttcagcaatactttgcaaattctatatctcggctattactgcctgtggatggtgcacatgctgcttcatgtgaagaaatggctactgcaatgtccagcgcagaggctgccgcttataaagggcttcaacaatgcattgaaactgtgatggcagaggtggagcggttgctgtcagctgagcaaaagccatctgattataaatcacccgatgatggaattgctcctgatcatcgtccaactaatgcctgcacgagagttgtggcttacctttcccgcgtgcttgaggctgcatttactgcgctagaaggtctcaataaacaagcattcctgactgaattgggaaaccgcttacataaaggcctgcttaatcattggcagaaattcacgtttaatcccagtgggggattacgcctgaagcgtgacataaccgagtatggagaatttgtgcgcagctttaacgctccttctgttgatgaaaaatttgaattgttgggcatcatggctaatgtctttattgttgctcctgaaagtctatctactttgtttgagggtacccccagtattcggaaagatgcgcaaaggtttattcagcttagagaggactacaagagtgcaaagcttgcatccaggcttagctcattatgggcaagctctacttgacactgatggggtatgctgatatgaaggtgaccttccaattctcttgaagatcttacctaaagaagttaatagcgggagaaggccgatacttaatggtggatagttttggttgcacaactgaatcatctcctcctgagaatcaggtatattggagtttttctcttataatattctttactcaattccaccatttttgagtatatattgtggaaacatgaatgggaaaacacgatggttgtatttttaaggcagcatttctatttaagttatatgttaggtttgcagtttttactttgaccattccaagttggaaagattctatgtttctaagtgcacctttgtaaatgatactctttaggaataaataaaagacatttaaggttggtttcaa

SEQ ID NO: 340 - DNA, 1783 bp, Citrus sinensis
aaaccactaaccacacaaagcaagcaaatcaaaataaactccattaatatttgaatttttattttttcttttcgttttaaattctctctttcgaggggaacgagaaacccgacccgagattcactgtcgcgctgtaccagaaaacacgactcaatctcaactcgaactcgaacatgggtttcttttcgttcctcggacgagtcctcttcgcttctctcttcattctctccgcttggcaaatgtttaatgattttggcgttgatggagggcctgcagcgaaggagttgatacctaagcttgctgttgcgaagaaacatatttctaaactactggggatagcaataccggatgtagaagttaggcacgtagttgccacaaatatctttctgaaaggagttggagggtttctatttgtatttggcaactcctttggagctttcctcctgcttgtctatgtggcgcttagctctccacttttgtatgatttctacaactacagccccaagcaccctgaattcactcctctcttaaacgagttcttgcagagcattgctatctttggtgcattgcttttctttattgggatgaagaactcacttccacggaggcaacacaagaagaaggctcccaaggcaaaagcaaattagatatacaagagaaacaaatttattctctcgggtgttacatattcttgggttttccactcaaaatgtaatgcagcatcagataatatgttgtggaggttcttcaaatacccgaaagtttggttattcttttacatttctaggattggttatgctgacagttccctgttcaaagggtgtattgtcgttttggaagatgaatggatcgcaatatatttgtttgttggagaagtatttgggaatggagcctaaaaaaaaaaaacctcgtgccgaattcggcacgaggctttatcagccgcatctttcctcctctctctttctcactatagaatccctagattttctctcaatttccctcattttctctccagaaaatggcaaatgcagcatctggaatggcagtcgacgatgactgcaagctgaagtttttggaattgaaggcaaaaaggacttaccgcttcatagttttcaagattgaagagaagcagaagcaggttgttgtggagaagcttggtgaaccatctgatagttatgagaattttactgctagcctcccagcggatgagtgccgatacgctgtctatgattttgactttgtgactgatgagaactgccagaagagcaagattattttcattgcatggtcccccgacacctcaaaggtgagaagcaagatgatttatgctagctccaaggacaggttcaagagagaattggatggaattcaggtagagttgcaggctactgatcctactgagatgggtcttgatgtcatgagaagccgttcgaattaaattttagacttgcctatggtgcaatggaaagcccatactatattgttcacttaaatgtaatgtctatatcttttatgacttataacttgctttgctatcggcttgtggtcggagttaaatacttttttaatttgtcttcccatttgttatatctgtggattaatagggtgagtatccccatatggtgtgatgataattacagactaatatataatggtttgtggggggtacatatctcattttagctttgattgcttgcaactgggtttttggcagtagtatcagtgtaatacatcagttacatgatttgttatggatgcaatttcttacatgagttagtatttt

SEQ ID NO: 341 - DNA, 948 bp, Citrus sinensis
ataaaagaagttggcagtctcaaaattttgttaaatcgttttgttcccaactgaactgaactcgcatcaagtcactctacaactataattatgtctatcactgagtacaatgggagcgcactcgttgcgatggtcggaaagaactgctttgccattgccagcgatcggcgcctcggcgttcagcttcagacaatagccactgattttcagcgaatttccaaaattcacgatcgcctttttatcggcctctctggactcgccactgattcccagaccttgtatcaaaggctggtgtttcgtcacaaattgtatcagctgcgagaggaaagggacatgaagcctgaaacttttgctagcttagtctctgctttgctttatgagaaaaggtttggcccttacttctgtcaacctgttattgctggattgagtgatgaagacaagccctttatctgcacaatggactcaattggagccaaggagcttgcaaaagattttgttgttgctggaactgctggagagtctctttatggtgcctgtgaggcaatgttcaagcctgatatggaacccgatgagttgtttgaaactgtatctcaagctttgttatcatctgttgaccgtgactgtttgagtggttggggaggacatgtctacattgtaacaccaactgaaataaaggaaagaatcttgaagggaaggatggattgatctataactgcagtgctgaaagccaccccttctcttgtgttcgctctccagtatttttcaattagaagaccgtagacttgaacttgactttcatttgtttatgaagaatgttgtttaatagctctcaaattgttgtactctgaaatagtttcaaactgaattgaccaagttcgtgggcttgcggttatctggatggatgaaagcgtttctatcaattgaggttttgatcttttgtgcttgcta

SEQ ID NO: 342 - DNA, 2106 bp, Citrus sinensis
cagattttctctcttgcacgcaattcagtttcacgaacgaaataaaatcaagagcccaaaaaaaaaaaaaaaaaatgcctcaaatcttgcctgatttctccaactcggtgaagctcaagtatgttaaactgggctaccaatatctggtcaatcacattctttatctcttgctcgtacctattatggttgcaattctcatcgaggtcctccgcttgggcccctatgaaattctcaacctttggaaatctcttcacttcgatcttgtccaaatcctatgctcatccttcctcatcatattcatagccaccgtttacttcatgtccaagccaaggcacgtctacctcgtcgactatgcctgctacaagccccccgtcacgtgccgcgtccccttcgccacattcatggagcactcgaggctgatcttaaaaaacaaccctaaaagcgttgagtttcaaatgaggatactcgaaagatccggactcggtgaagagacctgcttgcctccggccattcattacattcctccgactccaacaatggaagccgccagaggcgaggccgagctcgtaatcttctccgccatggattctctgttacaaaagacaggacttaaacctaaagacatcgatattcttatcgtgaattgcagcttgttctcgccgacgccgtcgctatcggccatgttgattaaccagtacaagctgaggagtaacatcaagagcttcaatctttcgggtatgggctgcagtgccgggcttatatccatcgacttagctcgggatcttctacaagtgcatccgaattcaaacgctgtcgttgtgagcacggagatcattacaccgaactactaccaagggaatgaacgagccatgctccttccgaattgcctcttccgcatgggtggagccgcgatcttgttatcgaaccggaggcgcaaccgttcccgagccaagtaccggctggttcacgtggttcgaacccacaaaggagctgacgacaaggcttatcgctgcgtgtttgaagaggaagacaaagagggcaaagtwgggatttcgctgtcgaaagatctcatggcaatagctggggaagctctcaaatcgaacatcaccacgattggtcccctggtccttcctgcttcggagcagttgctgtttctcatgacactcatcggtcgcaaaatctttaacccgaagtggaaaccatacattccggatttcaagcaggcgtttgagcacttctgtatacatgcgggtggaagagcggtgattgatgagttgcagaagaacttgcagctgtcagcagagcacgtggaggcctcgaggatgacactgcatcgttttggcaatacgtcgtcgtcgtcgctttggtacgagatgagctatatcgaagaaaaggggaggatgaagaagggagacagagtttggcagattgcgtttggcagtgggttcaagtgtaacagtgcggtctggaagtgtaacaagacgattaaaacgacgacggataacccttggtccgattgcattgatcgttacccagttcatattcccgaaattgtcaagctctagaaagcccttaattagcctcctcggtttcatttgctatgggttgctacagttattaggaataatctcttgcctcataatatttgatctgggatttgcatttgctgctgctgctgctgctgctgtgttgtgaacttaggctctatttgttactttgcacatttttaatttttctttgtcaaaatatatgcatctgccatatatagtcccgtatgcacattacatgtgttcaagtatgtaccatgtaaggaaaaacaaaaacacatcaaattggtgtttggaaaaaaaaaaacgtttaaacaagcgttgaaataaacctagacatgggggtgattaactattttatccccacggattaaatatatgtaatctgactcgaatgtgttaccatgtattggctgtacaaagggggaaatattatgatatgatatcatgtgtacgtgatatatcgatttttaattgtctgattttcttttatattttttattatttgcgtcatttggtaaatggtaaacttttcgacccttctattattggatagatt

SEQ ID NO: 343 - DNA, 717 bp, Citrus sinensis
ggggctggccactatagattttattttggtaccgaggcccccccctaatatctctctctctccagccatgtctctcatatgataaaatgcttcttctggcatgggtgtcgctgatcaaagctagaccacattccttgaactgcaaaggaagaaggtgcaccgctatgtgattttcaagatcgatgagaagaaaaaagaggttgtggtcgaaaaaactgggggcccagctgagagctatgatgatttcactgcttctttgccagagaatgattgtcgatatgcagtttatgactttgactttgtgacttctgagaactgccagaagagcaagatattttttattgcatggtctccttctgtatccaggatccgtgccaagatgctgtatgcaacatcaaaggataggttcacaagggagctggagggcatccattatgagatccaggcaactgaccccactgagatggatcttgaagtccttagggaccgtgctaactgagcacttagagaaacacccaggagtgaccaaaagaaacgcattttcctgcttcaattagttgctgattatgtgcactatctgttactgacacaacatacccatataacacctgagaagcatcatggcaataagggagcccaaaattcccctgtactgggtatcataccacgagcccctaatcagccttcccaggtgccaattatttaatagttaaactc

SEQ ID NO: 344 - DNA, 1012 bp, Coffea arabica
gattccgcacgaggtacaaaccgactgatttcaaaacttgagctccttgccttggcggatcagcactctctctctctccaaattctctcttcgtccagttagtcgcgatctctgcttctaccaattactcctactacgaaagtccaaagaatggccaacgcagcatctgggatggctgtgcatgacgattgcaagttaaggttcttggagctgaaagcaaaaagaacttaccgtttcattgtttacaagattgaggagaaacagaagcaggtggtcgttgagaaggttggtgagccgaccaaaagttacgaggacttcactgcaagtcttcctgtggatgaatgtcgctatgctgtctatgattttgattttgtgactgcagagaattgccagaaaagcaggattttcttcattgcatggtctcctgacacatcaagggtgagaagcaagatgatttatgcaagctcaaaagacaggttcaagagagagctggatggaatccaggtcgaattgcaagctacagatccaactgaaatgggacttgatgttataaaaagtcgtgccagctaaatatgaattgcggatatcttacaggggagagctcagtgctcagtgtacttgtcttttcttggatgaaatgtttatagcctgtggtatgaaattggctggagacgatacttgctacccagtgaagtgaactcatacatttatgatacttgctacccagtgaagtgaactcatatttgtcttctatttatgttgaatgacatttatgatattagtacatgatgtgatttactgttacttttaggatgtaatcattgagtgctattacttgtagtctgatgtctacaagataccgtgtaactgtttgtgaagatcgcgataagagttaaacacgcacaggaacatgttagctttttctggttttgggattttcgatttgtagttaattggatatgtgattttgactccctggggctttttggaattcctctctggactggtttgc

SEQ ID NO: 345 - DNA, 956 bp, Coffea arabica
gcagtctagtcagtaggacgaacatccactggtgcccacccaagccgctgccctcaaaatttccctattgatttctttattccttggattaaaatacagaagtctccttcttgcattttcttacagaagaagactccttcagtcgaaagaaaaaggcttctctcagtcttatatctctctcagcaagtgtctccgctccgaaatcaactcagctctaaattctcttccctccctccattttctcctccgactccgatcaccagtctttaaccatggctaatgcagcatcaggtatggctgtgcatgatgattgtaaattaaaatttttggagttgaaggcaaaaaggacgtacagatttatagtattcaagattgaggagaagcagaagcaggtaattgtggaaaaggttggtgagcctggtcaaagctacgaggactttgctgctagccttcctgctgatgagtgtcggtatgcggtttttgatttcgattttgtgactgcagagaattgccaaaagagcaggattttctttattgcctggtctccggatacatcaaaagtgcgaagcaaaatgatctatgcaagctccaaagacaggtttaagagggaattggatggtatccaggtagagctgcaagcaactgatccaacagaaatgggtcttgatgttttcaagagtcgtgccaactgaacttgaaaaacctcttgcattgcagtgaatttctgttgtgtcacttgctataagagcaaatgttaatagttctcttgggaggttgaacctggctaagatatgatattagcctctgatagacttgttcttatttagatcaagttatgtcacttcgctcttattggaagatttgttgtgtgtggaaactgtgccacgagactgcacttggataaccagtatttgtactatttatgctttgcatatttgcattccttcctacaagat

SEQ ID NO: 346 - DNA, 1137 bp, Coffea arabica
  misc_feature (1082)..(1082): n is a, c, g, or t
ctctctctcacaagccggacgtctcctccttttgctctcctcaaacaagaagaaaaaaagccctccaccgcccccgagttcccgaccaacgaaagcaagaagatggccgaagaagaaggagaggagtatctcttcaagattgtagtgattggggactcagcagtgggcaaatccaacttgctctcccgctttgcaagagatgaatttgaccataattccaaggccaccattggggtggagtttcagacccaggtggttgaagttgatggcaaggaaattaaggcccaagtttgggacactgctggccaagaacgtttcagggctgtcacttctgcttactatagaggcgctgttggggccctcattgtctatgatatcagcaggaaaacaactttcgagagtaccaaacgatggctggatgagctcaatactcattgtgataccactgtagcgagaatgctggttgggaacaagtgtgacttggaggacattagagatgtcagcgtggaggagggaaagagtcttgcagaagaggagggattattcttcattgagacatctgcactaaactcgactaatgtaaacgctgctttcgagatagtcatccgagagatatacaacaatgttagcaggaaaactctcaactcagattcctacaaagctgaattatccgtcaatcgagtcagcctggsmaatgggattgacttatccaagcaaaacaagagtttttcctcttgctgctccagatgagtttccatatctattggaggtttcatttccttttcttactttttatgtccatgcgagtccactgcagaggtgcttttgaagcctctgtttagagtgtttttgttgggcgtcctcatgagaaacctctggggatttagtgtgacaaaagattctacttctggaatggtgttgtgatattggcttcagtgtcatggagttgagtagtcctggatgcacgatgggcaaaatttgtaggatacaaatgaacgacattagcatgttgcaatttatttattttttgcggcatgtaaatctatgtgtcatatacgcactgagaaatctgctgtactctnacatctaattccctctgaacagtacggagaaaaaggggtgattttgattattttt

SEQ ID NO: 347 - DNA, 954 bp, Coffea arabica
aggaaaaggagtaggcctctttcttcttaacctctcggattgaaaagtctatctaaaacagcaaaactcttttatcggagccctagatttcctctcctcccatcgctctctccacggatttctcctcgtctcgatttgtcgcctcaaaacatggctaacgcagcatcgggcatggctgttcatgatgattgtaagctgaagttcttagaattgaaggcaaaaagaacttatcgcttcataatttataagatcgaagagaagcaaaagcaggttatcgtggaaaagcttggtgagcctgcaaatggctatgaagaattcactgcaaacctacctgctgatgagtgccgatatgctgtctatgactatgactttatgactgaggaaaatgtccccaagagcagaatcttttttattgcttggtcgccggatacatctaaagtcagaagcaagatgatctatgcaagctctaaggacaggttcaagagggagcttgatggtatccaggtagagttgcaagcaacagatcctacagaaattgggcttgatgttatcaaaagccgagctggtggagctgcttgagttgtcattcttgcagatgagggtcctccatacggcatgcgttgcttatgttaaatgtttatatttgtgtcaaagtagaacttgcttagatgatatatccgattgttgttcatcttttcattgcgtcttggcttcatgaaacttgggtgatctggcgtatactatcagtgttatttgtggatttatttactacttgggtgtgatttatcaagcaggatgttgtgtcttgtgcgcagggatagatttaatgtttgtagctggatgccccttttccttatatttttaattctgkacyggcatggctwtgaccatgttaatttcttttcgatccaaaagaatcgctggttgccaatgaaattccctttgctctgagtt

SEQ ID NO: 348 - DNA, 947 bp, Coffea arabica
ttcttctgctcttcaggcaagcccttaacacgcacgacacacrcaaactcataagcaattcgctatccctttaatctctctatatgtcgatcttcgagtacaatggaagtgccctggtggcaatggtggggaagaattgctttgcaattgccagcgatcggcggctgggagtgcagctgcagacaatcgccactgatttccagaggatttacagaatccacgataaactattcatcggactctctggtctcgctaccgatgcacaaaccctgtatcaacggcttgtttttcggcataagttgtatcagctgagagaagagagggacatgaagcctgaaacttttgccagccttgtttctgcgattctttatgagaaaagatttggtccatatttctgccaacctgtgattgccggattaggagaagaagacaaacctttcatctgcacaatggattcgattggagccaaggagcttgctaaagattttgttgttgctggaactgcttctgaatccttatatggtgcctgcgaagcaatgttcaaaccggacatggaagctgaagagttgtttgagactatctctcaggcactcctatcctcagtagaccgtgactgtttaagtggctggggaggacatgtttatgttgtcacacctacagaagtcaaagaaaggatcttgaagggaaggatggattgacgtagttggatatttgtcttttttttttcagtaatttcggcctttgacatttgtcattggtcatctttgattatwaaagttgtgagaacatgttttggggagggatttgccacattcctttactcattgactgtaatctatacctcaaatttacgaactaaattttagtagttggaccagaagataagacatctcatggtaacgactttaactgcaattctagccccatttcaattaaaggtggtttat

SEQ ID NO: 349 - DNA, 1017 bp, Coffea arabica
gagcagaaaagatttgctttattaattcaaaaatatcaagaaatctcattcttaaagttctatttgattatttcaccagtagactagtcagcgtagttctgtactagtagacctggggtagattgaggagtaatggcagggtacagagctgaagatgactatgactacctgtttaaggtggttttgattggagattcaggtgttggcaagtccaacttgctttcaagattcaccagaaatgagttcagcctcgagtccaagtctacaattggtgttgagtttgctaccagaagcttgaatgttgataataaagtcatcaaggctcagatttgggatactgctggccaagaaaggtatcgggccatcaccagcgcctattaccgcggtgctgttggtgccttgcttgtgtatgatgtgacacggcattctacttttgagaatgtagaaaggtggttgagggaactgagagatcacacagatcccaatattgttgtcatgcttgttggcaacaagtccgatctccgacaccttgtggcagtctcaactgaggatggaaagtcttttgcagaaagggaatcactttatttcatggaaacttctgcacttgaagctacgaatgtggatagtgcatttgcagaggtccttacgcagatttaccatatagtgagcaagaaggccatggaggctggtgaaaatggagctaatggaacagttccatcaaagggagagaaaatcgatgtcggtaaggatgtatccgccatgaagaaaggtggctgctgttcaacatagtttttaaccaagttgatatgcagcattctgaggtgtttatttaaattgctggatgtatgtctacactgagattgtagctaaagtttctaaattaagcgcctacatagacgtggaaattgtctatctgttattatttttgttctaaatatttgagcaggactgctgttgcatctagcaagcagaatttggttagaaatgaaatgttggtcctgttgttttcatttattc

SEQ ID NO: 350 - DNA, 1947 bp, Gossypium hirsutum
cgactggagcacgaggacactgacatggtgaaggagtagaaatctccctcacaaaaacaacaccttttttcaattgcttcatttccaccactgcaacaatgccacatttttctaactctgtcaagcttaagtatgtcaagcttggctaccaatatctcgtcaatcatattcttacacttactcttatacctgtcatggctggtgttcttattgaggttcttcgtttaggccctgctgggattgttagtctctggaattcccttcattttgatcttgttcacatcttgtgctcttgtttcttcattatctttgtagccactgtttacttcatgtctaagcctagaagcatttaccttgtggattatgcatgctacaaacctcctgtcacttgtcgtgttccttttgctactttcatggagcactcgaggctgaacttgagcaacaaccctaagagcgttgaatttcagatgaggattctagaaaggtctggtcttggtgaagagacttgtttacctcctgctattcattatattcctccaactccaaccatggaagctgctagaggcgaggctgagattgttatattctcagctatggattctttgttcaagaaaacggggttaaaacctaaagacgttgatattcttattgtcaactgcagtttgttttctcctacgccatctttgtctgctatggtgatcaacaaatataagctgaggagtaatataaagagctttaatctttcaggaatggggtgcagtgcggggcttatctccattgatttagctcgagatcttctccaagtacaccctaattctaatgcagttgttgtcagcactgagatcatcactccaaactactaccaaggaaaagaaagagccatgctccttcccaactgtcttttccgcatgggtggcgccgcaatcctcttgtcgaaccgtcgttccgagaggtggcgtgccaagtatcgtcttgtgcatgttgttcgaacccataaaggtgcagatgataaagcctatcgatgcgtgttcgaagaagaagacaaagaaggcaatgttgggatatctttatctaaagatctcatggctattgctggagaggctttaaaatctaacattaccactattggtcctttagttcttccagcatctgagcaactcctatttctcctcacactcattgggcgtaaaatctttaatcccaagtggaagccatatattccagacttcaagcaagcgtttgaacacttctgtatccatgctggtggacgagcagtcatagatgaactgcaaaagaacctgcaactttcagcagagcacgtagaggcatcaaggatgacattgcataggtttggaaacacatcgtcttcatcgctgtggtacgagatgagctacattgaggcaaaggggaggatgaaaaaaggggacagggtttggcaaatagctttcggaagtggattcaagtgtaacagtgcagtatggaagtgcaacagaaccatcaaaacaccaaaagatggaccatgggcggattgcattcataggtacccagttcatatccctgaagttgtcaagctctaggctaaaagcaacaaacaaatatggttgattcatggctttgtcaaactcagatccttctggatctctgcatttatttatatttctcctgttaactttttctctactcattttgtttctgtcatactgtatcctttttccattttcttttcaaaatcatgagtttgcataggtacccgatatggtgctctttgtatttgttaattaatgtacaccctgcaggggaaaataacaagtgtggaaaaacaacaggttgaattagccattgcaataaaacctgaaatattaataaagaaaatgctatacaagttgtgattgtacatgaaagaacaattgggtcaaatttcccagggttttcaaaaaaaaagaaaaa

SEQ ID NO: 351 - DNA, 1343 bp, Gossypium hirsutum
aagccccaacgttcaaggacatttccccacattttctggagtccaacggagcagacaattagtcttttacatttccaactcataccaaaaccaaaacaactagattttttttcttaggcagatctcaaaagaaaaggcttttaatatacatagaagccgcgggccatcccctcgttcacacactcgtttatttacttgacgcaaagaaagagggtaacagctgtggttctgaaaaagagtaaagatggctggttacagagctgaggatgactatgactatcttttcaaggtggttttgatcggtgattccggtgtcggaaagtcaaatctgctctcgaggttcaccaggaacgagtttagcctcgagtccaagtccactattggtgttgagttcgctacacgtagcttgaatgttgatggaaaggtcatcaaggctcagatttgggacactgctggtcaagaaaggtatcgtgccataacaagtgcctattatcgaggagctgttggcgcacttcttgtgtatgatgttacacgacactccacattcgaaaatgtcgagaggtggttaagagagttgagggatcacacagatcccaacattgtagtcatgctcattggtaataaatccgatcttcgtcaccttgtggctgtctcaaccgaagatgggaaatccttcgcggagaaagaatccctctacttcatggaaacttctgccctggaagctactaatgttgaaaatgcatttgccgaagttctgacacagatctaccatatcgtgagcaagaaagctatggagaccagcgaggaagggaatgcttcagctgtcccatcaaagggagagaaaatcgatgtgggtaaagacgtgtcagctatgaagaagggaggttgctgctcaagctaggatgatcacactaatctgaagtcagattgtttaaatgatgcggccggggtttcgatttcatcataaaccttggttttgtaaaattttcttaaaagggtgcctaaagtaggagatctgagcagagattgaattaatttttcattcattttttttccctgatgactgttattgttagtagacaagaggattacgaagaacagggtcttacactattgcatttaaatatgtgcttagaacgtctgtttacttagaacaaattgtgcccaactcttttgttggaaaaaccaaaagccatttgttttttcatttttcaaacagatcccaaaaaatccccgtaacccatcataaattatttcaaaagtttgtttgatttaaccaaaccaaaatgttatggaatttcatgagctttatgatgaaatgggttacggggttttcaatgatg

SEQ ID NO: 352 - DNA, 1113 bp, Gossypium hirsutum
gagagagagtaaagatggctggttacagagctgaggatgactatgactatcttttcaaggtggttttgatcggtgattccggtgtcggaaagtcaaatctgctctcgaggttcaccaggaacgagtttagcctcgagtccaagtccactattggtgttgagttcgctacacgtagcttgaatgttgatggaaaggtcatcaaggctcagatttgggacactgctggtcaagaaaggtatcgtgccataacaagtgcctattatcgaggagctgttggcgcacttcttgtgtatgatgttacacgacactccacattcgaaaatgtcgagaggtggttaagagagttgagggatcacacagatcccaacattgtagtcatgctcattggtaataaatccgatcttcgtcaccttgtggctgtctcaaccgaagatgggaaatccttcgcggagaaagaatccctctacttcatggaaacttctgccctggaagctactaatgttgaaaatgcatttgccgaagttctgacacagatctaccatatcgtgagcaagaaagctatggagaccagcgaggaagggaatgcttcagctgtcccatcaaagggagagaaaatcgatgtgggtaaagacgtgtcagctatgaagaagggaggttgctgctcaagctaggatgatcacactaatctgaagtcagattgtttaaatgatgcggccggggtttcgatttcatcataaaccttggttttgtaaaattttcttaaaagggtgcctaaagtaggagatctgagcagagattgaattaatttttcattcattttttttccctgatgactgttattgttagtagacaagaggattacgaagaacagggtcttacactattgcatttaaatatgtgcttagaacgtctgtttacttagaacaaattgtgcccaactcttttgttggaaaaaccaaaagccatttgttttttcatttttcaaacagatcccaaaaaatccccgtaacccatcataaattatttcaaaagtttgtttgatttaaccaaaccaaaatgttatggaatttcatgagctttatgatgaaatgggttacggggttttcaatgatg

SEQ ID NO: 353 - DNA, 489 bp, Gossypium hirsutum
gagagagagtaaagatggctggttacagagctgaggatgactatgactatcttttcaaggtggttttgatcggtgattccggtgtcggaaagtcaaatctgctctcgaggttcaccaggaacgagtttagcctcgagtccaagtccactattggtgttgagttcgctacacgtagcttgaatgttgatggaaaggtcatcaaggctcagatttgggacactgctggtcaagaaaggtatcgtgccataacaagtgcctattatcgaggagctgttggtgcacttcttgtgtatgatgttacacgacactccacattcgaaaatgtcgagaggtggttaagagagttgagggatcacacagatcccaacattgtagtcatgctcattggtaataaatccgatcttcgtcaccttgtggctgtctcaaccgaagatgggaaatccttcgcggagaaagaatccctctacttcatggaaacttctgccctgg

SEQ ID NO: 354 - DNA, 1070 bp, Gossypium hirsutum
ggctggtacagagcagaagatgactatgattaccttttcaaagtagtattaatcggtgattcaggtgtgggaaaatctaatttactctcaagattcacaaggaacgagttcagcttagaatccaaatccaccattggtgttgagttcgcaactcgaagcttaaatgttgatggcaaagtcatcaaagctcagatttgggatactgctggtcaagaaaggtaccgagccataacaagtgcttattaccgaggagccgttggtgcactcctcgtgtacgacgttacccgtcattccacattcgagaacgttgagaggtggttaagagagttaagggatcacacagatcccaacatcatagtcatgctcatcggtaacaaatcagatcttcgtcacctcgtggctgtcccaactgaagacgggaagtctttcgccgagaaagagtctctctacttcatggaaacttctgcwctcgaagctacaaatgtmgagaaygcattygccgaagttcttactcaaatctaccatatcgtaagcaaaaaagccatggagacagccgacgaagggactgcatcaaccgttccttccaaaggcgagaaaatcgatgttggtaaagacatctccgcaatgaagaaagggggttgttgctcaagctaagaaaatgacataaacccgaacatccaattgtttaacgacgcagctgggggtcgttctgctgtgtcggttttgtagaatcttctcgaaaaggcgcctaacagtaggaatttcgggtgagatcggttcggtttacatccaaattttttttccagggaattatattgttgaatttarataggtgaattgggctatcaatgatgtttgtagtgtttatgttagtttaggacatgcttttacctttttatgaatgttacaaaggacaattgtggtgtttaaaacttaaaatctttcaagcaatgaacaccttttgattgttgtggscatgccataagtccctgtayywtktygtaartttrtcwttwtgtaaatttattttgtaaatttayttttatgccataaatttttgtattttttgt

SEQ ID NO: 355 - DNA, 1073 bp, Gossypium hirsutum
gatcttaccaagtatagcttttttcttttgcctttttgtcatttcccttaattaattgtctcttatggagtctgttctcttttttgttgataatttcaattttctatcttctcttcaaaatatggaattggatcaataacgtgagagaccaacaatgttacattttggattaccaatgctacaagcccagtgatgataggatggtggggactgagttctgcggggaagtgataaagaggaacaagaatctcggactcaacgagtacaagttcttgctgaaagccattgtcagttcaggcatcggagaacaaacctacgccccgaggatcatgttttccggaagagaagagagcccgaaactggaagatgggatcttggaaatggaagagttttttcacgatagcatcgagaaggtgttatcaagggcaggcatatctcctcaagaaatcgatctcttagtcgtcaatgtctccatgttatccacagttccttctttgtgttctcggatcataaaccactacaaaatgagaccagacatcaagtcttttaacttaactggaatggggtgtagtgctagtctgatttctcttgacattgttcgcaatgtcttcaagtcttacaagaacaagttcgcattgcttgtgacttcggaatcgttgagtccgaattggtatgctggcaacgatagatcgatgattctctccaattgtttgttccgttcgggtggctgcgcagtacttttgacaaacaacaagtccttgaagcatcgagcaatgttcaaattgaaatgcttggtgagaacacatcatggagccaaagatgattcgtatggttgttgtatccaaagggaagatgataaaggaaggatgggatttcaccttagcaaaagccttcccaaagccgcaactcgttctttcgtcgataatttgagggtcatcaccccaaagatcctgcctgttagggaactagtacggttcatggcagtttcactccttaaaaaatggaacgtcgtccgccatggttcttcccacaagggagcttctcaaggaccaatcaaagctggggtgaacttc

SEQ ID NO: 356 - DNA, 1002 bp, Gossypium hirsutum
actggggcaagttttcaccgaaataaaaggacctttgtccctccccaccatatttcaacactcgtcatcggaagagctacctttttttttctccttttccaccgccgtcgatctcgatccttatcctcgttttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaagccgtgctaactgaatacggttcttttaggcatctgcaaccgggaagcttccttccttcctacctacagtatgtctttacttaagtgaaatgtttataggtttcgaaacggcaaactcgggatttccgagttatgccataagacttttatcagtctcgatgatgataaacccgtagtttcgggtatatgtgatttgttatctatagaacctatgtgttgagtgcctttgtgtagtctttatctctttcaacgctaaatgcaactgtttgtgagggttagacgacacatttagttcgttttcaagttttttttttttttaattttctttgaatattgacccttgtttattgtttcggagtgttaaagagggcatgcttttatgtctttcaagtcactgattctttttgccattatttatgacactggatttgattgcaaatttatt

SEQ ID NO: 357 - DNA, 960 bp, Gossypium hirsutum
cggaagagcttccttttttttctctccttttccaccgccgtcgatctcgatccttatcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattcaggtggaattgcaagcaacagatccaactgagatgggtctcgatgtgttcaaaagccgtgctaactgaatacggttcttttaggcatttgcaaccgggaagcttccttccttcctacagtatgtctttacttaagtgaaatgtttataggtttcgaaacggcaaactcgggatttccagagttatgccataagacttttatcagtcttgatgatgataaacccgtagtttcgggtatatgtgatttgttatctatagaacctatgtattgagtgcctttgtgtagtcttaatctctttcaacgctaaatgcaactgtttgtgagggttagacaacacatttagttcgttttcaagttttttttttctttaattttctttgaatattgacccttgtttatttgtttcagtgtgttaaaaagggcatgcttttatgtctttccagtcactgattctttttgccattatttatgacactggattcgattgcaaatttattggtacaatatctttttgctggttgata

SEQ ID NO: 358 - DNA, 923 bp, Gossypium hirsutum
atttgcctttaaatcttcttcactatatagtaatctcatttcttcacctctaagagtttaccgatacatatatgtaacatcttcaatctttgtttcccaaaattaccatgccaaagccattccatttgttggtcttcttccttgttgctctttgtctatgcaccagttcaaatgccagcagtactaccaatgagttcctagaaactgagtgcttgaaagtaccagcaactgagtttataggttctttgaaaaccaccattgatgctattcgaaaagctacctccgttgtttctcaatttggcggcttttttcatgattttcgtctctctaatgccatttctgattgtcttgatctgcttgactcttctgctgatgaactaagttggaccatgtctgcttcccagaatcctaatgctaaagataacagtactggtgatctaagttctgatttaagaacatggttaagtgctgcaatggttaaccaacagacatgcattgatgggtttgaaggtacaaatagcatggtcaaaactgtagtatccggtagcttgaaccaaatcacttcactggttcgtaatcttctcatcatggtgcaccctggtcctaattccaagtccaacggtacccgtaatggcagccaaaaaggtggtggtggtgggggtcatccaggccagaaccggtttccggtatggttcaaaagggaggatcggagattgttgcaaataaatggggtaacagcaaatgttgtggtggcagcagatgggagtgggaatttcacacgcataatggatgctgtggagacagcaccagataagagtttgaacagatatgttatttacattaagaagggtttatataaagagaatgtggagatcaagaagaagaaatggaaccttatgatgattggtgatggaatggatgtc

SEQ ID NO: 359 - DNA, 864 bp, Gossypium hirsutum
caaaaaagaaaggaaaaaaaattcaaaaaagaactagaaatttattatcgctcacagtctctttgagaaagcccaataattccctctctcatttttaattttagatatttttgttgccctagattttctctgtaagctctacctagagaagaagccatggctaatgcagcgtctggaatggctgtgcatgatgactgcaaactgaagttccttgagttaaaggccaaaagaacataccgctacatagtattcaagattgaggagaaacagaagcaggttgttgtagaaaagcttggtgagccaagtcaaagctatgatgatttcacttcaagcctccctgctgatgaatgtcggtatgctgtctatgattttgactttgtgactgctgagaattgccaaaaaagcaggattttcttcattgcatggtctcctgacacctcaagggtgagaagcaagatgatttatgcaagctcaaaggacaggttcaagagagagttggacggtattcaaatagagctgcaggcaactgacccgactgagatgggacttgatgttattcgaagccgtgccaactaaattggcatctccaaatggcaggaataatggagatggtaaaatgctttctgcttttgtttcaagtgaaatgttaatagtttggtggggtggtatgattttggtttgttgttcagatgttatatccaagtctttgtctagaacaagtttagcaatttccatttgaatcttatgattctgttatgcatgtctcaaagttatcggacggagtgtcttacagctgagtcgataaacaaaagtctcatcttcttgaagagtatatgaagcactcttttttgaggggttttttcc

SEQ ID NO: 360 - DNA, 1769 bp, Gossypium hirsutum
atggaaaagtaccacctttcaggcaaaatgtggcggtgataactgctggtaaccctgatataggaaaagaaatggcttcgccaccagctggcaagtcccctgttggatctcctggcggcggcggcggtagttcctctggaaatggtgaaaagaaattgaatacggggacagttgtgggttctgcaattggtgcagttggtggcttgagtcttcttgttttgggtatctgtttgtatgctagaaaaggaaagcgtaccagtaaagtgcggagtccagctactgtagtcatacatcctcatcattccggtgaccaagatggagttaaaatcaccgttgctggatcgagcgtcactggtggaagtgaaactttcagccactcaagcagtggaccaactgatgttcacttggttgaggctggcaacatggtgatctcgattcaagttttgagggatgtgacaaataatttcagtgaggaaaatgtgctaggaaggggtggttttgggacagtttacaaaggggaattacatgatgggacaaagattgcggtgaaaaggatggagtccagtgttgtgagcgagaagggtttggccgagtttaagtccgagattgcagttcttactaaggttcgtcaccgccatttagtcgcacttcttggatattgcttggatggaaatgagaggcttcttgtatatgaatatatgcctcaagggacccttagtcggcacctattcaactggaaacatgaaggactgaaaccacttgaatggactagacgacttacaattgccctagatgtcgctcgaggtgttgagtatctacatggtctggcacaacagagtttcattcatcgagatcttaagccatcaaatattcttctcggagatgatatgcgtgccaaggttgcagattttggcttggtccgtctagctcctgtggatggcaaacagtcaattgaaacaaggctagcaggaacctttgggtatttggcaccggagtatgcagttactggacgagtaaccacgaaggtagatgtatttagctttggtgtgatcctcatggaattgatctcaggccgaagggcacttgatgaaactcagcccgaggaaagcatgcaccttgtgtcatggttccgtcggatgcacatgaacaaagacacattccggaaggccattgacgaaacaatccggcttgatgaggaaacgctagccagtgttagcacagtgactgagcttgctggccactgttgtgctagggagccctaccagaggccagatatgagccatgcggtcaatgtgctgtcatcactagcagagctctggaaaccagcagaacccgattcggatgacatctatggcattgaccttgaattaactttaccccaggcattgaaaaagtggcaagccttcgaggggaacagcagtgtggatgactcctcatcatttctgggcagtacagacactacacagaccagcataccatgccggccgccaggttttgctgattcattcgcatcagctgatgcccgatgaaagacacaaagaacaacaacgcaagtttctagtgtcaaatcgattgttccaagatgtttgggtttgttcattccttctacttcatttcccattacaatctttgctctcatcagttatagtttgtcagagacggtttctttctcccatttatttatctcagtagtttgaacaactgaaattttcgaatgtattgtacaagttatcgaaatgcaatcgagtaacgacgtatcttgcatgtct

SEQ ID NO: 361 - DNA, 864 bp, Gossypium hirsutum
agaagccatttattatattattattttcttcgagttttgccttcagattcttcctctttgtaagttcaaatctaaaaagccatggcaaatgctgcttctggaatggccgtgcatgatgactgcaagctgaagtttctagagctaaaggctaaaaggacataccgcttcatagtattcaagatcgaggagaaacaaaagcaggttgtcgtggaaaagcttggtgagccaagtcaaagctatgacgatttcactgctagcctccctgccgatgagtgtcgatatgctgtatacgatttcgactttgtgactgctgagaattgccagaaaagcaggattttcttcattgcatggtctccggacacatcaagggtgagaagcaagatgatttacgcgagctcaaaggacaggttcaagagagagttagacggtattcaagtagagctgcaggcaaccgatcccaccgagatgggactcgatgtcataagaagccgtgccaactaaatcggagtctccgagaggcatgggtatttgaattcttttctgcttttgcttttagtgaaatgttaatacggttgcgggaggcggtaatatcgacctgactgaactttgatattggtttgttgggtaagttttttttatatagaattcttcagtctcgaacaaattatatgggtttgttatgcgcagaggttgtatgaccggatgtgtttatagtttgattcattagaaccaaaagtctatctacttcaatggtatgaatatgacactatttcttttaggtttgttcctgcatgtataaaaatggatatttcggttactcgtgttgctcgtacggattgaaaatggtggcctgtgggtgtttga

SEQ ID NO: 362 - DNA, 805 bp, Gossypium hirsutum
gccaaccccaaaaaagaaaaaaagagaaaaaaaaaactcttaagtccatcaattatcactacaatctctttccccttattttctctccaaagaagccctaaattttctcagcctttcttgctctttccctcgctttctcgggaaaaaaaatggcaaacgcggcttcaggaatggctgtgcatgatgattgcaagctgaagtttttagaactgaaggctaaaaggacttaccgcttcatagttttcaagattgaagaaaaacaaaagcaagttgttgtggaaaaggttggtgaacctactgatagctatgaggctttcactgctagccttccagccgatgagtgtcgatacgctgtgtatgactttgattttgtgaccgatgagaactgccagaagagcagaatttttttcattgcctggtctcctgatacatcaaaagtaagaagcaagatgatctatgcgagctcaaaggacaggttcaaaagggaattggatggcatccaggtagagttgcaagctaccgatccttccgagatggatctcgatgtcataaggagccgtgccaattgaaatgtatgtaccatttcttcattgaaatggaactttatactatgtggttcacataaatgtaatgtctatatcaactttggatcttggaacttgctttgatattgggttatatctgtggattcttatggggtatgtgtgtgttccccctttggggtaccaaatttcataacgatttgactattacatgcctttccttttatgttggattatataaacttagctgaaattatgtatta

SEQ ID NO: 363 - DNA, 660 bp, Gossypium hirsutum
tttaagatatcataaaaaggaaaaaaaaaatgaagctcttgtttctaactttgctgctttgttctcttcttctatgttcttcagtttttgaaccaacaatggctcagcctcgttcacctttttgtgaagggaaatgcaaagggaggtgcaataaagcggcggtttgggatcgatgcttcaaatattgcggcatatgttgcgaggagtgtaaatgtgttccttccggtacttttgggaacaaacacgagtgtccttgctacagagacaaggtgaataacaagggcaaacccaaatgcccttgaaaatgaaatatattcgagttcgggatttcatcaagcttaaagatcgaggacgaagaggctatatatatatatgcatgctgatggtgttattataaaaatgaactgttttattgctgttgttttccttcgggtttttgttttggtagtgttgaataaaatttcccttatattttcccatcaccgccgtgtccaccgccatgcacacatgttttgttgtcttttgatcatgggtggcggtggtggtggtgaaaatggtgccattcacaggtgtctgcagggtcggtaaaatgcatttaaaaagtagaaaaatgttgtaacctttttcaacgaggtttatgagtaatttaagaattttgtt

SEQ ID NO: 364 - DNA, 1733 bp, Gossypium hirsutum
  misc_feature (50)..(50): n is a, c, g, or t
gggaaatatagaaagtttggctgcaattccgtagactaggatgcttgcancatacactctctcaaaacagtgatcctaaatttcagaattcaaaatttcttcaatttgtatcaaagatgagtcgtggcgaacttatcattgatgataatcaggtcaaaccagcatcagagaactgggcaacagaatatcagcaacagtacaatggaggtgcttcttgggctgatgaatttgttcatgatgaggttttccgtggacctgaccattgggccaatgaatttggtgctgaaagattgcaacaagagtctgttgatgatcaatgggtcaatgaattctcaaagttgcatgttgatgactgggcagaagaatttggtcgtcaagttggtgagggggctttgggagatagttcgtctgataactgggcaaattcatatgatgagttccttaatgagcaattagctgctaagcagcggtcggacgcttcaaggggtgtttatgtattttctgatatgaatccatatgttggtcatcaaaatcctttaaaagaaggtcaagagctattcaggaaagggcttttgagtgaagcagtgcttgccctagaggctgaagttatgaaaaatcctgagaatgctgaaggttggagattgctaggaataacccatgctgaaaatgatgatgaccaacaggctattgcagcaatgatgcgtgctcaggaggccgatcctaccaatctggaagtacttcttgctcttggtgtgagtcatacaaatgaattggaacagactgctgctttaaagtatctgtatggatggttacgtcatcacccaaagtatggtactcttgcgccaccggagcttgctaattctttgtattatgctgatgttgctagattattcaatgaagctgctcagatgtctcctgaggatgctgatgtacacattgtccttggtgttctgtataatttgtcgagagaatatgataaggccattgcatctttcaaaactgctttgaaacttaaacctaatgattattctctttggaacaagcttggtgcaacacaagccaacagtgtgcagagtgctgatgcaatattagcttatcaacaggcactagatttgaagccaaactatgtgcgtgcttgggcaaacatgggtatcagttatgccaaccagggtatgtatgaggagtcgatccgatattatgttcgagctctggcaatgaatcccaaggctgataatgcatggcaatatctaagaatatctttaagctgtgtctcgcggaatgatatggtggaagcttgtgattccaggaatcttgagattttacagaaggagtttcctctatgaatagaatatgattccgaatttttaagtaggatgggtatcatgactaactgaaacaggggcaaaatgttactgtcaaaaatcaattcaaaaagctgtagatgctgatgtacccttgacaggttgcagctagggccatgctggtagatggtatctggggggaacaaataatgttttgtatattttatttatgtctcaacaccatgaagtatgtaattttgttaaacggggtatgggatggttgatagcgaaagataatgtttgttaggtgggaggagagcaggaaaagcaattacggactagtgattagctgcaataagctactttgtctctcacttaaaagtaattgctgattgttgaaaatggtacggaacgacgaacaactggtctgcc

SEQ ID NO: 365 - DNA, 1223 bp, Gossypium hirsutum
gaacaactcaactgaatcctaaccggacataccgggtcaaaacttggagctttgagaatagcggactgtcctccaatccatcctagactcttcttcttcggttctttcttcttcgtcatttaaaatctcaatttattaaaatcaaatcagtttcttgtgcaatcaacaccgaaaaccctaaaatttccaatgtcgatcttcgagtacaatgggagtgctctggtagccatggtaggcaagaactgcttcgccatcgctagcgatcgtagactcggagttcaactccaaacaatcgccactgatttccaaaggatttctaaaatccacgatcgtgtctttctcggtctctctggccttgccaccgatgctcaaacattgtatcaaaggcttgtctttcggcataagttgtatcagctaagagaagagagggacatgaaacctgaaacttttgctaaccttgtttctgctcttctttacgagaaaaggtttggtccatacttttgccaaccagtaattgccggattgggagatgaagacaagcctttcatttgcaccatggattccattggagcaaaggagcttgcaaaagattttgttgtggctggcactgcctctgagtctctttacggtgcctgtgagtcaatgttcaaggaggacatggaacccgaggaattgtttgaaacggtttcgcaagctctcctttcatcagtagatcgtgactgtcttagtggttggggaggacatgtctatgtcgtcacaccaacagaagtaaaggaaagaatcttgaagggaaggatggattgagtgaagccaagggctctcaagattcttgttttccagactataaaacttcaggtttttgtttcatttgcagtgctggaaggaagatgatgttattattgtgtgttaaattctgaaatttttgaatggcctatttatagtccctctattttcgtctgatgggatatgggcatatgaaagcacgattaggcaggccgatggtcaggtgaggtggcagatttgttggccgctgacgagaatcattgcctattatttagttggaagacatctggcagcaccgagccgaagctccagtgaatgtgaccattgaaataaaaaattgaattgacctattagatcgaaaagcagtggtttgtttggtcttgatactaatcaaaatattcaaattggtttaaaactagttgaaattagttgagtttata

SEQ ID NO: 366 - DNA, 744 bp, Gossypium hirsutum
acaaaacttgaactcttcaagaccattcgacaatggtgacaatccctttctttgtcctaaacatcctccttttcctctccagctccgcggctacaccaaagagcggtgcagatcacgacctggtccgttcatcatgtgtccacgccagctatccaagcctctgttttcgcaccctttcttcctactccggcccagccaacaccccacgtgagttagcccaagccgccgtaaaagtcagcctgtcccgtgcccgtaaagtgtcgaactacttgtcgacgagtgtgacggggtacaacaagagggaacgagtcgcactgagtgactgcgtggagcaaatagatgagtcgatggaggagttgagcaagacattaggggagttgaagcacttgagaggggagacgttcgagtttcagatgagtaatgcgcggacatgggtgagtgcggcgctgacgaatgaggacacgtgtcttgatgggttcgaaggagttgacggcaaggttaaatctaatgtgaagaggaagatcacgaatgtggctaaagttaccagtaatgctctgtacatgatcaataggctcaatgaaagtcgtggtaggcaccgttgaatctttgatgatgatgatgatgaataatggatggttgtgatttatctagcttattatggttcttaaatatagtttttattttgattttggttgcaagctgtatatgtaatgttttctatttatatattaagcataaggtgat

SEQ ID NO: 367 - DNA, 1922 bp, Gossypium hirsutum
gcgctgggaagcagtgccatgcaacattatgtggcaacccgtccaatgttcattgatgtagaaatcatgaattcagacaccagattagttcttggcgtaccagggttctcaagctagtcctagcaatgttgctccgtgggctttcttcattatacaaagaaatcacagatactgtgcgcaaagaagcagcaacaattatggcagtattcccgtctcctaatgatgttatgtcaattttagttcagcgagttttggagcagagagttactgctcttttagacaaattattagtgaagccatctcttgtgaatcctcctcccatggaggaaggcggacttttattgtatttgagaatgctagctgtggcatatgagaagacccaggaacttgctagagagctacgagccgttggatgtggtgatttggatgttgaaggtctcacagagtctctattttcatctcacatggatgaatatcctgaacatgaacaagcatctctcggacaactgtatcaagcaaagttggatgaactgcgtgctgaaaaccagaatgtttctgattcaactggaactatagggcgctctaaaggggcttcagtggcttcttcgcatcagcaaatatctgttgcagttgtgacagagtttgtacggtggaatgaagaagcattaaccagatgcactttattttcgtctcagcctgcaacacttgcagccaatgtaaaagcagtgttcacttgcctacttgaccaagtcagccaatatattactgatggactggaacgggctagagatagcttgactgaggctgcagccatgagggaaaggtttgtgctaggtacaaatcttagtagaagggtggctgctgcagctgcttctgcggcagaagctgcagcagctgctggtgagagcagtttcagatctttcatggttgctgtacagcgttgtggcagtagcgtggccatagttcagcaatactttgcaaattctatatctcggctcttattgcctgttgatggtgctcatgctgcttcttgtgaagaaatggctacagcaatgtctagtgcagagggtgctgcttataaagggcttcagcaatgcattgaaactgtgatggctgaggttgaacgattattatcagctgagcaaaaggcaacggattaccgctcacctgatgatggaatggctccggatcatcgtcctacaaatgcctgcacaagagttgttgcttatctttctcgggttctggaggctgcgttcactgcactagagggtcttaacaaacaagcattcctgactgaactgggaaatcgcttgtacaaaggactacttaatcattggcagaagtttacttttaatccgagtggaggactaagactgaagcgtgacataacagagtatggagaatttgtgcgtagttttaatgctccttctgttgatgagaaatttgaactccttggaatcttggccaatgtttttatcgttgctcctgaaagtctgtccagtttgtttgagggcacacctagtatccggaaagatgcacaaaggtttattcagcttagagaagactacaagagtgcgaagcttgcatctaggctcagctctttatggtcgggttctagttgatgtagaggtggggttgttgttggtattcaaatatgtagctctctttgtttgtcgttgtttttggacaatttatcatctcaactcaagcattttccttggttttgaggccccaataccaagcaagagctgattccagagaatacagaatacatattaggatattgatttgtcagttttcatttctagcattcaaggagattcatgacggacgtgacgcagagatttaatattatatccaaatgatcccgcctaacgtctacacaacttttactttgtggtgacaataaatacaaaatgaat

SEQ ID NO: 368 - DNA, 650 bp, Gossypium hirsutum
aaaggaaaaaaaaatgaagctcttgtttctaactttgctgctttgttctcttcttctatgttcttcagtttttgaaccaacaatggctcagcctcgttcacctttttgtgaagggaaatgcaaagggaggtgcaataaagcggcggtttgggatcggtgcttcaaatattgcggcatatgttgcgaggagtgtaaatgtgttccttccggtacttatgggaacaaacacgagtgtccttgctacagagacaaggtgaataacaagggcaaacccaaatgcccttgaaaatgaaatatattcgagttcgggatttcatcaagcttaaagatcgaggacgaagaggctatatatatatatatatatgcatgctgatggtgttattataaaaataaactgttttgttgctgttgttttcctttgggtttttgttttggtagtgttgaataaaatttcccttatattttcccatcaccgccgtgtccaccgccatgcacacatgttttgttgtcttttgatcatgggtggcggtggtggtggcgaaaatggtgccattcacaggtgtctgcagggtcggtaaaatgcatttaaaaagtagaaaaatgttgtaacctttttcaacgaggtttatgagtaatttaagaattttgtt

SEQ ID NO: 369 - DNA, 988 bp, Gossypium hirsutum
gcggggaactggggcaagttttcaccgaaataaaaggacctttgtccctccccaccgttttcaaccctcgtcatcggaagagctttcctttttttctctctatattttctcatctccttttccaccgccgtcgatctcgatccttatccccgttttcaaaaaagctccaaaaagatggccaatgctgcatcgggaatggctgtgcatgatgattgcaagttgaagttcttggaacttaaggcaaaaagaacccaccgctttattgttttcaaaatcgaggagaagcagaagcaagttattgtggagaagcttggtgagccaaccgagagctatgaggattttactaaatgtcttcccgctgatgaatgtcgttatgctgtgtacgattttgattttctaacggccgagaacgtcccaaagagcagaatctttttcattgcatggtctcccgatacatcaaggatcaggagcaaaatgatatacgctagctccaaagacagattcaagcgagaactggatggaatccaagtggaattgcaagcaacagatccaaccgagatgggtctcgatgtcttcaaaagccgtgctaactgaatacagttcttttaggcttttgcaacggggaagcttccttccttcctacagtatgtcttttacttaagtgaaatgtttataggtttcgaaatggcaaaacttggacaattaccgatttccaagtttttccataaagacttttatcagtctcgatgatgataaacccgtagtttcgggtatatgtgatttgttatctatagtacctatgctttgagtgcctttctgtagtcttttatctccttcagcgctaatatgcaactgtttgtgagggttagacaacacatttagttcattttcaagttcatttttttttcggtttaatttcattgaatattgacccttgtttgttttctttcagagtgttaaaaagggtatgctttcatggcttacgagt

SEQ ID NO: 370 - DNA, 1219 bp, Gossypium hirsutum
ctgagctctgccatttattaaaatttcctcccwaaaaataaatcaaaaattaatataaaaatccataaaagaacccgacccggtgacccggaatggcggcgtatagagcagatgatgactacgattwyttattcaaggtggtgttgatcggagattcaggtgttgggaaatcgaatttgttgtcgagatttacgakgaacgagtttagccttgaatccaaatccacaatcggagttgaattcgccacccgaagtattcgggtcgatgataaggtcgttaakgcacagatttgggacaccgccggacaagaaagataccgagcgattacaagtgcatactaccgtggagctgttggtgcgttgcttgtctatgatgtcactcgacatgtcacatttgagaatgttgaaagatggttgaaggaattacgaggtcacacggattcgaatatcgtgattatgcttgttggtaacaaggcggacctgcgacacttgcgtgctgtttccaccgatgatgctaaggcctttgccgagagagaaaataccttctttatggagacatctgcccttgagtctatgaatgttgagaatgcattcactgaagtactaactcaaatacatcatgttgtcagtcgaaaagcacttgaagtaggagatgatcctgcagcattaccaaagggacgaaccatcaatgtaggaagcaaggatgatgtttcagccgtcaagaacgctggctgctgttctgcttaaatgttagatgatatatcctccatttttcgtatctttaagcacaagatttgagattgaagtcaaaggagaaagtagcagcttccaaatttccttcatttgatttcggttccttactcgtggttcttttatggtattggtctccctagtgtaatgttccatttcatagttttgatagtttttgttgtatttgattgctttagaatacatagcagacagatctagtttgggtttctaaataattttcattagttgtggatgataaattttgaattatttaagacaatacatcttaaattcctccatasgtgagtgccagagatgtgtacaaaatgggattgcaaatgggttggtttcagcgtggaaaaaaaaagaaaaaactcgggatctttaggcgccggggcctagtttccaccggggggccgggagggcaatgccctgaagtggttatagcagcgaaagaacaaagtaagaac

SEQ ID NO: 371 - DNA, 1068 bp, Gossypium hirsutum
ctccttctcaccagtcccccaaaaaacatcccagaagaaatccctggaattccacttctctccttgtctcactatccatgtctgctttccttctcctttcccttctttccctctcccatttcttcatcttctcttcttccagtcatcacccacctcataactcccctgtttacgcctctgagtcctctcaaatccgccttgcttgcaaatccactcgcttcccacaaccctgcgaatcctccctttcgcgatcctctcttctccctcctaaatcgacctccctccaattcatccaatccgccatttccgtctcttccgataacctcaaaaccgggcaatccatggtgaaatccatcctcgactcctccaaaggcaacctcaaccgctccaacgccgccgccatctgtctcaacatcctttctaattctgattaccgcataagatcgaccaatgacgctctggcacgtggcaagatcaaggacgctcgtgcatggatgagcgcggccttttgctaccaatacgattgttggagcgcgctcaagtacgtaaatgacaccaaattggtcggtgaaacgatggcgtttttggactctttaacgcaacacagcagcaacgcgttgagcatgatggtcgcctacgataattacggggaggacatagccgcgtgggtccctcccaagacggaacgggacgggttctacgagaacgggtcgggtgggacggagctggggtttaacgggggtttaccgtcaaacttgaagacggacgtaacggtgtgtaaagacgggagcggagggtgttacaagacagtgcaagaggccgtcaacacagcaccggcaaatgcagagagtacacgccgtttcgtgatatatataaaggaaggtgtgtacgaagaaacggtgagggtgccactggagaagaaaaatgtggtctttttgggggatggaatgggtaaaaccatcattacgggtgctttaaatgcagggatgcctggacttaccacttatgagactgctactgtcgggggtcttggggatggatttatggcgagtgggctcacaatccgga

SEQ ID NO: 372 - DNA, 653 bp, Gossypium hirsutum
  misc_feature (642)..(642): n is a, c, g, or t
tgccgtttcaccgcataccaacgccactgaagaggtgactgagaaccagtaccctttagaaaaatatttttgaaatctcgctattaaccattttcacaactttctttccctccccacttccaggttgctagattattcaatgaagctgctcagatgtctcctgaggatgctgatgtacacattgtccttgttgttctgtataatttgtcgagagaatatgataaggccattgcatctttcaaaactgctttgaaacttaaacctaatgattattctctttggaacaagcttggtgcaacacaagccagtgtgcagagtgctgatgcaattatcaacaggcactagatttgaagccaaactatgtgtatgcttgggcaaacatgggtatcagttacgccaaccagatgaagacaggatgtgtggccctagttttatgtctaaatatcagtgtcgatccacccgatgtaataaaaatatctccttgcgcaagaatagagtgctggactgatcctttttctacggcaccacaaaaagcagtggaaactattgggaaaaacttgagagatcaatatgagaagtggcagcccaaggcttgcagtaaggtcgaaagtgatcctacagtggatgaaatgaagaaacttntgtatacatga

SEQ ID NO: 373 - DNA, 1384 bp, Gossypium hirsutum
gctgctctgcaattatccccctcacactcttttaactgttcttcccttttttacccttccaccactactacaacaaagcagccatttcagtcgctgacccaaccacaccgacgaaaccataatcaatggctgccgcgttacaattacaaacacacccttgcttccatggcacgtgccaactctcacctccgccacgaccttccgtttccttcccttcttcctcccgctcgtttccatctagcagacgttccctgtccgcgcatgtgaaggcggcggcgtcgtctttgtccaccaccaccttgcaggaagggatagcggagttctacgaccagtcgtctgggctttgggaagacatttggggtgaccatatgcatcatggtttttacgatccggattccaatgtttcaggctccgatcatccagctgcccagatccgaatgatcgaagaatcgctccgtttcgctggaataaccgatgatccagcaaagcagcccaagacaatagttgatgttggatgtgggataggaggcagctctagatacttagcaaggaaatttggagcagaatgtcaaggcattactttgagccctgtccaagctggaagggctaatgttcttgctaaagatgaaggactagcagacaaggtttcatttcaagttgcagatgctctgaagcaaccattccctgatggtcagtttgatctagtttggtctatggaaagtggagaacacatgcctgataaagctaagtttgttaatgagttggcacgagttgcagctcctggaggcactataataatagtgacatggtgccatagggatcttggtccctcagaagaggatttggagccatgggagaaaaagctgctaaataggatatgtaatgcttactatttacctgagtggtgttctacttctgactatgtcaaactacttcagtccctatctctccaggatataaaggctgctgattggtctgagcgtgttgccccgttttggccggcagtgatacgctcagcatttacctggaagggcttcatatcactgctacgtagtggattaaaagccataaaaggtgcattagtgatgccattgatgatccaagggtaccagaagggtgtgatcaagttcgctatcatcacatgccggaaacccgagtaaaccgccacgacaaccaaatgttttactctgctgcattaatttgaaacataattcatcttcatagttgtaataggggtgtgtcagtgtcaccccccaattgcttatttcaagtataaaataaagtaagtctgggtttcctctcgtttctggaacttgttagtcttattgtaggccaataaaatcaatcagtctatagaatgcatggagaactattgtaacattgt

SEQ ID NO: 374 - DNA, 1258 bp, Gossypium hirsutum
accgaaataaaaggacctttgcccctccccaccgtttttcaaccctcgtcatcggaagagctgtcctttttctctctctatattttctcatctccttttccaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctccaaagacagattcaagcgagaactggatggaatccaagtggaattgcaagcaacagatccaaccgagatgggtcttgatgtcttcaaaagccgtgcaaactgaatacagttcttttaggcttttgcaacggggaagcttccttccttccttcctacagtatgtcttttacttatgtgaaatgtttataggtttcgaaatggcaaaacttggacaattaccaatttccaagttttgccataaagacttttatcagtctcgatgatgataaacccgtagtttcgggtatttgtgatttgttatctatagtacctatgttttgagtgcctttctgtagtcttttatctccttcaacgctaatatgcaactgtctctgagggttagacaacacatttagttcattttcaagtttttttttttttttgtttaatttcattgaatattgacccttgtttgtgtttttttttcagtgttaaaaagggtatgctttcatgaattacgagtcactgattttttttttttggtattatttatgacactggatttgattgcaaatttatttgaacgagatatttttgctggttgatatttgttggtgaagagacttggtcttgaagtgtgagattgattgtcaagtgtgagctactttttggctgtttgttttttgggtgattgctaagtattggatttggatgccaactttgaatgtttgataatgatgctgtatcatcttctctcaactaatatctttctcatgcttttgacttgtttgattgttttgtcggttgttt

SEQ ID NO: 375 - DNA, 1263 bp, Gossypium hirsutum
caatccaaaaaaactaaaaacaccccacccccacttatgagagagagagagagasagagaggagaaaattttcaytctcaacaagggttttttgggtatatttatttgtttgattgattgatttcagagcgatagcgaagaagaagaagaaatgtgggaatcgatttgtttaacattggtagcaacagcgggtaataacataggcaaagttctacaaaagaagggcactgttatcctccctcctctctccttcaagctcaaggtgataagaacatatgctgttaataaattttgggtgataggatttctgatggatatttccggtgccttgttgatgttgagagcattatctttggctccggtatctgttattcaaccagtctctggctgtgggcttgccattctttcgatcttttcgcacttctatctgcaagaagtgatgaacattgttgactggatggggattacattagctggtattggcaccataggagttggtgctggtggagaggagcaagagtcttcggcagtatcgattttacagctaccgtggttggcattcgttgtcrtgatcgtgtttgtaggtactcctaaatggctggcgtcgcatctacaagcgtcaacggagagaacaagagctgatagagtatgaagttgttgaaraaatcatatatggcctggaatcaggaatwttatttggaatggcatcagtgatatcgaagatgggatttgtcttcgtggagcagggcttctccaaaatgttgattcccctatgtatctcaatcagcatttgttgtagtggcactggattttactatcagacacatggcctaaagcatggtcgagcaattgtgatctccacctgtgctgccgtggcatcaatcgtgactggtgtacttgccggtatgcttgcattgggtgaacagttgccttcagcaccagttgctcgcctttcacttcttcttggatggttatttatcatgatgggtgtaattttgcttgtgagttcaacaagattgatgcgacacattccgtggccattacgaaacttaatacckagtggagtggaccggaacttcaatctcaggcgatcaggttctcttcgagtcaaggaccctagtccgagtgctgttatcccagccgccacattgcaccatctgatttcaacaccagcgaaagagaaagcataggtgaagaaaaacaaaagctgaatacatattgaaaatcagaatcaattttatcgaatatcatctcttaaaagtt

SEQ ID NO: 376 - DNA, 888 bp, Gossypium hirsutum
taagtccatcaattatcactacaatctctttccccttattttctctccaaagaagccctagattttctcggcctttcttgctatttccctcgctttctcgggaaaaaaatggcaaacgcagcttcaggaatggctgtgcatgatgattgcaagctgaagtttttagaactgaaggctaaaaggacttaccgcttcatagttttcaagatcgaagaaaaacaaaagcaagttgttgtggaaaaggttggtaaacctactgatagttatgaggctttcactgctagccttccagccgatgagtgtcgatatgctgtgtatgactttgattttgtgaccgatgagaactgccagaagagcagaatttttttcattgcctggtctcctgatacatcaaaagtaagaagcaagatgatctatgcgagctcaaaggacaggttcaaaagggaattggacggtatccaggtagagttgcaagctaccgatccttccgagatggatctcgatgtcataaagagccgtgccaattgaaatgtatgtaccatttcgactttgaaatggaactttatactatgtggttcacataaatgtaatgtctatatcaactttggatcttggaacttgctttgatattgggttatatctgtggattcttatggggtaatgcctttccttttatgttgaattatataaacatagctgaaattatgtgttaccggtgcatgaaacttccatattacttgcatttgaacaattgcaaattatttatggccttgagtagacttgttcaaagatttggttatcaagttagaaggtctcgttttaatgtattttctatattaaatgatattttttaaataataaaagaagtgatataggcgagctttaggt

SEQ ID NO: 377 - DNA, 1247 bp, Gossypium hirsutum
agaaactatcccctgtttcacactctctttctcatattgttactccacacaaagcaaaagggaaagtaatatagtatcaacatcagtggttttgagaggaaaaaaggaagggtgaaatatggctggttacagagcagaggatgactatgactaccttttcaaggtagttttgatcggtgattcaggtgtggggaagtctaatttactctccaggttcaccaggaacgagttcagcctcgagtccaagtctactattggcgttgagttcgctactcgtagtttgaatgtggatggcaaggtcattaaagctcagatttgggacactgctggtcaagaaaggtaccgtgcaataacaagtgcctattaccgaggagctgtgggagcactccttgtgtacgacgttacacgccactccacattcgaaaatgtagagaggtggctaagagagttgagggatcatacagatcccaacatcgtagtcatgcttgtcggaaacaaatcagatcttcgtcaccttgtggctgtctcaaccgaggacgggaaatcctttgctgagaaagaatccctttacttcatggaaacttctgctctggaagctactaacgtggaaatttcatttgctgaagttcttacgcagatatacaacgtcattagcaagaaagctatggagacaagcgatgatggggctgcttcagctgtgccctccaagggagagaaaatcgatgtcggtaaagatgtctcggcaatgaagaaagggggttgctgttcaagctgatatcgatctgaaagtctggggtttgttcagctgcattgatttctttgtaaaccattgtttcgtcacatatacgtaaaaagtgtgcattgtggaggcccgaacttgacttgtgaagtattgtccgcttttaacataggtccgagtttaagtctctacatataatatcatggtagatgcttaaaatttcttgatataggattggggtgttacatccataagctaaagtgctaaagtaggggattagcagataatggagattgagttacttgttggaaaatactattttctatcctttttccattttcaggcagatctaaaatgagtgaatggttttaaaggtattactttttgaggaaaaaaaaacaccttaaatgaagaaaaatatttgtttttgtagcttttctttcatctttttggtcaattgtaagggtggttaaaattaataagaaaaaaaataaataaaagaattttc

SEQ ID NO: 378 - DNA, 726 bp, Gossypium hirsutum
cttcctcaaatcttcttcttctttttgtcttctgtgtttttttttagtccccaaatggattctccctttcccttcaaatggcaacccctcccctttcatcccctacttatctcaccaccaatttaggcgtcggctacgccatcgtcgtcgccctcggcttcctcctcctcctctccactctcctcctcgcttcctacatttgcttccgctcttcctcgccccttccacctcgtgccatttcccccaaccccatttcaacacccaccgcctccaactccaacggtatcgtcctccccaggattgttttcatcggcgaagaagaccatgaacacgacgaagaaaacgtcgtcgtctttgggcttgatcgtgccgtcataaactcttaccccaagttccggttcagcaaagaggaggtgtctacggcggtggaggtgacgggttctagtgctgggaacaccatttgttcgatatgtttgtgtgagtatagagaatcagagatgttgaggatgatgcctgaatgtaggcattgttttcatgtaacttgtattgatgcttggttgaaacttaatgggtcttgtcctgtttgtcggaactcaccgcttccgacaccgatttctacgcctttgtcggaagttgtacctttgtctcagtacgatgctgatcggaggaggtggtgacttttggcttttgggttaccatgcttaatgaatggtgatttggtataaa

SEQ ID NO: 379 - DNA, 743 bp, Linum usitatissimum
  misc_feature (699)..(699): n is a, c, g, or t
  misc_feature (705)..(705): n is a, c, g, or t
cctctctctctctctatctaattctctcctcttccgatatatccgatctcctccttttcttccgctgttgagctccactgagaaaactcggaccaaatggcgaacgcagcgtctggatttgcagtcgatgatgactgcaaactgaaattcctggagctaaaggcaaaaagaacctaccgcttcgtagttttcaagatcgaggagaagcaaaagcaagtcattgtggagaaacttggtgagccaggtgaaagctatgatgatttcgctgcttgcctccctgctgatgagtgccgctatgctgtatttgattttgacttcgtcaccaaggagaactgccagaagagcagaatattcttcattgcatggtctccggacacagcaagggtgagaagcaagatgatctacgccagttcaaaggacagattcaagagagaacttgacgggattcagatcgaattgcaagcgactgatccaactgaaatgggacttgacgtgtttaaaagccgtgccaactgaatgggagatatcatggccatcagccattgacttcttctattcaggcttgtttacacttatcaccgggtgaaatgcttatatatagtatggatgaattgtgaaaattgtgatactggtttccaattatttacgttttcagcatgagtatgtggtttgtgtggaagtgcttttgtttttaattgntatcgnttgtggaagggcttaggtgaggctaaggtccagaagtg

SEQ ID NO: 380 - DNA, 984 bp, Vitis vinifera
ccccgtgtggcaccgaataaaaaggcttcctcagctgagtcctcgtcatcggaggggctctctatattgtctacaaacgctagatcctctcaagtctcggtcctcgtcgtcgatcgtacagcgaaaatggccaatgcagcatcaggtatggctgtgcatgatgattgcaagttaaagttcttagaactgaaggcaaaaagaacttaccgcttcatagttttcaagatcgaggagaagcaaaagcaagttgttgttgaaaaggttggtgagcctgctcaaagctacgaagatttcactgcaagtcttcctgctgatgagtgtcgatatgctgtctatgattttgattttgtgaccgaagagaattgccagaaaagcaggattttcttcattgcatggtgccctgattcatcaagggtcagaagcaagatgatttatgcaagctccaaagacagatttaagagagagcttgatgggattcaggtggagttgcaagcaactgatccaactgagatgggccttgatgttattagaagccgtgcctgctgaatatgaactgtagtcattgcgatgaagcatctctccaggcagtcttcttttgagtgagaaatgtttatagtttgtgggatggtgaacttggatagacatgatattggtttccaagttctacagaatagtctcttttattcatcttgaacaacatctgtgtttttcggtatatcatgtgatttcttatttgtagaacctatgcatcgagtgtctccttgtagtctgatgtctacaagctaatatgtaacagtttgtggggggttagacgacacctttagtttgttttcaaattttaaattcatatttgaccctcttttatctttcttgagtgctaaaaaatggcatgctgttatgccttgccagtggctggtttgttgctgtgtttgatgatcagataaatatattgagaggactaatatccgttcttccatttcttcc

SEQ ID NO: 381 - DNA, 866 bp, Vitis vinifera
ccccgtgtggcaccgaataaaaaggcttcctcagctgagtcctcgtcatcggaggggctctctatattgtctacaaacgctagatcctctcaagtctcggtcctcgtcgtcgatcgtacagcgaaaatggccaatgcagcatcaggtatggctgtgcatgatgattgcaagttaaagttcttagaactgaaggcaaaaagaacttaccgcttcatagttttcaagatcgaggagaagcaaaagcaagttgttgttgaaaaggttggtgagcctgctcaaagctacgaagatttcactgcaagtcttcctgctgatgagtgtcgatatgctgtctatgattttgattttgtgaccgaagagaattgccagaaaagcaggattttcttcattgcatggtgccctgattcatcaagggtcagaagcaagatgatttatgcaagctccaaagacagatttaagagagagcttgatgggattcaggtggagttgcaagcaactgatccaactgagatgggccttgatgttattagaagccgtgcctgctgaatatgaactgtagtcattgcgatgaagcatctctccaggcagtcttcttttgagtgagaaatgtttatagtttgtgggatggtgaacttggatagacatgatattggtttccaagttctacagaatagtctcttttattcatcttgaacaacatctgtgtttttcggtatatcatgtgatttcttatttgtagaacctatgcatcgagtgtctccttgtagtctgatgtctacaagctaatatgtaacagtttgtggggggttagacgacacctttagtttgttttcaaattttaaattcatatttgaccctcttttatc

SEQ ID NO: 382 - DNA, 954 bp, Vitis vinifera
ttttcttttctccgacaccgaacaacactcgaatctctcactccgaaaagtagagtgtattttactatttttatcttcaaattcgtttcaaattttcctccttcggtggctgctttttcttctttgtttccctgaaattctctctctgcagatcgcatcaggcagctatgtcgttcagagggtcaaatgcttcatctggcatgggtgttgctgatcactgcaaagccacatacctggaactacagaggaaaaaggtgcaccgttatgtgatttttaagattgatgagaagaaaaaggaagttgtggtggaaaagactggtggtccagctgagagctatgatgatttcactgcttccttacctgagaatgattgccgctatgcaatttatgactttgattttgttacttctgagaactgccaaaagagcaagatattcttcattgcatggtccccttcagtatctcgaatccgtgccaagatgctgtatgctacatccaaagatcggttcaggcgggagctagagggcatccattatgagattcaggctactgacccgaccgagatggatcttgaagtgcttagagagcgtgcaaactgaacgcttgtgaatcaaggaggtttcagatcttgaaaacccttctagggttttttggtggccttaaaggacaaactttcctacttaagttaatagctgattatgtgcaatatctgttcctggcacaaggatataatctatacacatatatatagacaaacattaaataacttcacagctgggaaggctgattaggggtgcattgccaggatatcccaagtgcaggggaatcagggcttccttattgccatgatgcttctcaggtggaaatgggtatgttatttatattgatgatcgaactcttatttataaagtgggtatttatcggtggaatgtctcctttttattctttgaaaaa

SEQ ID NO: 383 - DNA, 975 bp, Vitis vinifera
tattttattatttcatcaatatatatagagataaatatattcagatatttcccttatatcatctgccctagattttctctttgccatttctgtgaaccccctcgatcatctccgatcgtttcctagaaaccatggctaatgcggcgtcaggtatggctgtgcatgatgactgcaaactaaagtttttggagttgaaggcaaaaagaacttaccgcttcatagtgtataaaattgaggagaagcaaaagcaggttgttgtggaaaaggttggtgagccaactcaaagctacgaggactttacagcaagccttcctgctgatgagtgccgatatgctgtttatgattttgactttgtgacagaagagaattgccagaagagcaagatctttttcattgcatggtcgcctgatacatcgagggtgagaagcaagatgatttatgcaagctccaaggacaggttcaagagagaactagatggtatccaagtagagctgcaagcaactgatccaactgagatgggtcttgatgttattagaagccgtgccagctaaatacaagtctcctatgctgcaacggggagttcctccattctctctgctttacttttaagtgagatgttaatagtttgtggggcagtgaagctgactgaactatgatattggtttgttgtccaagttaccttacagtattttcttcatctagaacaattcactgttttcatttatattttataatttggctgtgtggaaattatgggtgtctgcttaaggatatgtctacaagtacatgtgtatcattgtctggggatacacaataccttttggtttttgatgactttgaaaatggatgtttttgaccattttgagccctgctgtgtttacaaaaagggctgactaccatacttccggagctaatttggttggtgtggtattcacttcattagaaatgatataaattgggtggtgtaatgcattt

SEQ ID NO: 384 - DNA, 1026 bp, Vitis vinifera
tattttattatttcatcaatatatatagagataaatatattcagatatttcccttatatcatctgccctagattttctctttgccatttctgtgaaccccctcgatcatctccgatcgtttcctagaaaccatggctaatgcggcgtcaggtatggctgtgcatgatgactgcaaactaaagtttttggagttgaaggcaaaaagaacttaccgcttcatagtgtataaaattgaggagaagcaaaagcaggttgttgtggaaaaggttggtgagccaactcaaagctacgaggactttacagcaagccttcctgctgatgagtgccgatatgctgtttatgattttgactttgtgacagaagagaattgccagaagagcaagatctttttcattgcatggtcgcctgatacatcgagggtgagaagcaagatgatttatgcaagctccaaggacaggttcaagagagaactagatggtatccaagtagagctgcaagcaactgatccaactgagatgggtcttgatgttattagaagccgtgccagctaaatacaagtctcctatgctgcaacggggagttcctccattctctctgctttacttttaagtgagatgttaatagtttgtggggcagtgaagctgactgaactatgatattggtttgttgtccaagttaccttacagtattttcttcatctagaacaattcactgttttcatttatattttataatttggctgtgtggaaattatgggtgtctgcttaaggatatgtctacaagtacatgtgtatcattgtctggggatacacaataccttttggtttttgatgactttgaaaatggatgtttttgaccattttgagccctgctgtgtttacaaaaagggctgactaccatacttccggagctaatttggttggtgtggtattcacttcattagaaatgatataaattgggtggtgtaatgcatttacatgcttttcagttatgttgtttaaataatattcctttttgttattcatg

SEQ ID NO: 385 - DNA, 1047 bp, Vitis vinifera
cagggaagacgctcccacagcattttagtttggctctcggaactcagtcgcatattcatcgtcaccgatgtcgatcttcgagtacaatggcagtgcgctaatcgccatggttggcaagaactgctttgcaatcgccagcgatcgccgattcggcgttcagctccagaccgtcgctaccgattttcagaaaatttacaggatccacgatcgggtttttctcggtctgtccggactggctaccgatgctcagactctatatcaacggcttgtttttcggcacaaactgtatcagcttcgagaggagagggatatgaagcccgaaacctttgcaagccttgtatctgctcttctttatgagaaaaggtttggtccatacttctgccagcctgtgattgctggattgggagatgaagacaagccattcatttgcacaatggattcaattggagccaaggagcttgctaaagattttgttgttgctggtactgcctctgagtctctttatggtgcctgcgaggccatgttcaagcccgacatggaacctgaggaattatttgagatcatctctcaagcactgctctcatcagtagatcgtgactgcttgagtggttggggaggacatgtctatgttgtcacaccaactgaagtgaaggagaggatcttaaaaggaaggatggattgacctttctccacagagctgatagttgatccccttctatatctgcatttggttacctgttttcttccttcccatctgtggcctgcatttgaagtggaaacctgttatcatgtctttagtgatttgtgctgactttttctgcagtgctctaattgatgtaaactgataaattttaaagttacatctccccagcaattccagtggaaggataggtccttttgatttataaaatttgtatgctattgaatatttcttccaagaaagacgcgttactacatggatttagccattgttttatcagtctttcctggtatactctcttatagacattatgcttccttatcaatcttttatgtagattagttttg

SEQ ID NO: 386 - DNA, 900 bp, Vitis vinifera
ataaatcaactttatctctgcggtcacccacgaccttcaccgccagtacctgaaaaggcctcattttcaaggtcggaagcctaatctccattcactttctttgccgagccctagattttctcggcctttgtcgctgtttccttctctttcgcttcggaaaaatggcgaacgctgcatcagggatggctgtgcatgatgattgcaagttaaaatttttggagctgaaggcaaaaagaacctaccgctctatagttttccagattgaggagaagcaaaagcaggttattgtggaaaaggttggtgagcccactcaaagttacgaggattttgctgccagccttcctgcggatgaatgcagatatgctgtctatgactttgactttgtgactgaagagaattgccaaaaaagcaggattttcttcattgcatggtctcctgacacgtcaagggtgagaagcaagatgatttatgcaagctcaaaggacaggttcaagagagagctagatggtattcaggtagagttgcaagcaactgatcctactgagattggtcttgatgttattagaagccgtgcttgctgaattaaatgcccggtggtgcgatgggaagtcctccatactgtctgctttacttatgtgaaatgttaataggttgtgggacacagaacttgcttagatatgatattggcttgttgttcagtttcatattcgaagccttgtcttcattccaaccaactccagtgatcttgggtatactttgtattttgttatttgtggaactctgtgcaagtatctccatttggcttgaaatctacaaactaatgtgtgatggtcttgggggtttagacatcacctttcagtatgtttgcatgtttaaaatggatgttgcccctttttacct

SEQ ID NO: 387 - DNA, 1340 bp, Vitis vinifera
ataaatcaactttatctctgcggtcacccacgaccttcaccgccagtacctgaaaaggcctcattttcaaggtcggaagcctaatctccattcactttctttgccgagccctagattttctcggcctttgtcgctgtttccttctctttcgcttcggaaaaatggcgaacgctgcatcagggatggctgtgcatgatgattgcaagttaaaatttttggagctgaaggcaaaaagaacctaccgctctatagttttccagattgaggagaagcaaaagcaggttattgtggaaaaggttggtgagcccactcaaagttacgaggattttgctgccagccttcctgcggatgaatgcagatatgctgtctatgactttgactttgtgactgaagagaattgccaaaaaagcaggattttcttcattgcatggtctcctgacacgtcaagggtgagaagcaagatgatttatgcaagctcaaaggacaggttcaagagagagctagatggtattcaggtagagttgcaagcaactgatcctactgagattggtcttgatgttattagaagccgtgcttgctgaattaaatgcccggtggtgcgatgggaagtcctccatactgtctgctttacttatgtgaaatgttaataggttgtgggacacagaacttgcttagatatgatattggcttgttgttcagtttcatattcgaagccttgtcttcattccaaccaactccagtgatcttgggtatactttgtattttgttatttgtggaactctgtgcaagtatctccatttggcttgaaatctacaaactaatgtgtgatggtcttgggggtttagacatcacctttcagtatgtttgcatgtttaaaatggatgttgcccctttttacctttatttgtattggaaaaggggaagcctttggctccttaaggctgagttggtttattagtccttcttttggatgaattaaaatatttgttacaagttaatgtttttgtcttgttttgttttgttgccattgctgttttttttgtgggctgggggagggaaattataactgttatgtaatgctttagttagataaaaattttcttgtggttttggtacttggttgtgatgatagttctctttggttgttgcttgcctcatggatcactgttggtgttatggctgtcaacttttacttctaattttagatggtggtgcataaagcatattttgtctatgtacttgtgttttgttgtaccactactaactttggagcatcattgaggtgagttttgttgaacttttaccctatgtttggttatttgaaaatttgagataaagga

SEQ ID NO: 388 - DNA, 979 bp, Vitis vinifera
ataaatcaactttatctctgcggtcacccacgaccttcaccgccagtacctgaaaaggcctcattttcaaggtcggaagcctaatctccattcactttctttgccgagccctagattttctcggcctttgtcgctgtttccttctctttcgcttcggaaaaatgtaggggtgttgaatctttaccgcacttcctctttttagcacccttctttcactttctcagtcttcttttggcaagaatggcgaacgctgcatcagggatggctgtgcatgatgattgcaagttaaaatttttggagctgaaggcaaaaagaacctaccgctctatagttttccagattgaggagaagcaaaagcaggttattgtggaaaaggttggtgagcccactcaaagttacgaggattttgctgccagccttcctgcggatgaatgcagatatgctgtctatgactttgactttgtgactgaagagaattgccaaaaaagcaggattttcttcattgcatggtctcctgacacgtcaagggtgagaagcaagatgatttatgcaagctcaaaggacaggttcaagagagagctagatggtattcaggtagagttgcaagcaactgatcctactgagattggtcttgatgttattagaagccgtgcttgctgaattaaatgcccggtggtgcgatgggaagtcctccatactgtctgctttacttatgtgaaatgttaataggttgtgggacacagaacttgcttagatatgatattggcttgttgttcagtttcatattcgaagccttgtcttcattccaaccaactccagtgatcttgggtatactttgtattttgttatttgtggaactctgtgcaagtatctccatttggcttgaaatctacaaactaatgtgtgatggtcttgggggtttagacatcacctttcagtatgtttgcatgtttaaaatggatgttgcccctttttacct

SEQ ID NO: 389 - DNA, 976 bp, Vitis vinifera
ataaatcaactttatctctgcggtcacccacgaccttcaccgccagtacctgaaaaggcctcattttcaaggtcggaagcctaatctccattcactttctttgccgagccctagattttctcggcctttgtcgctgtttccttctctttcgcttcggaaaaatggggtgttgaatctttaccgcacttcctctttttagcacccttctttcactttctcagtcttcttttggcaagaatggcgaacgctgcatcagggatggctgtgcatgatgattgcaagttaaaatttttggagctgaaggcaaaaagaacctaccgctctatagttttccagattgaggagaagcaaaagcaggttattgtggaaaaggttggtgagcccactcaaagttacgaggattttgctgccagccttcctgcggatgaatgcagatatgctgtctatgactttgactttgtgactgaagagaattgccaaaaaagcaggattttcttcattgcatggtctcctgacacgtcaagggtgagaagcaagatgatttatgcaagctcaaaggacaggttcaagagagagctagatggtattcaggtagagttgcaagcaactgatcctactgagattggtcttgatgttattagaagccgtgcttgctgaattaaatgcccggtggtgcgatgggaagtcctccatactgtctgctttacttatgtgaaatgttaataggttgtgggacacagaacttgcttagatatgatattggcttgttgttcagtttcatattcgaagccttgtcttcattccaaccaactccagtgatcttgggtatactttgtattttgttatttgtggaactctgtgcaagtatctccatttggcttgaaatctacaaactaatgtgtgatggtcttgggggtttagacatcacctttcagtatgtttgcatgtttaaaatggatgttgcccctttttacct

SEQ ID NO: 390 - DNA, 1736 bp, Vitis vinifera
gtggcatacgaaaagactcaagaacttgctagagatctacgagctgtaggatgtggtgacttggatgttgagggtcttacagagtctctgtttcttgctcacaaagatgagtatcctgaacatgagcaggcttctcttagacaactctatcaagcaaagatggaagaaatgcgtgctgaaagccagcagctatctgaatcatctgggacaatcggacgctcgagaggagcttctgtagcatcttcccaccaacagatatctgttaccgtggttacagagtttgtgcgttggaatgaagaagcaatttctaggtgcactctgttttcatctcagcctactacccttgcaaccaatgtaaaagctgtgtttacttgcctgctagaccaagtcagtcagtatataacagaagggctggaacgggctagagacagcctaaatgaggctgcagttttgagggaaaggtttatgctgggcacaagtgttagtagaagggtggctgctgcagctgcttctgccgcagaagctgctgctgctgctggtgaaagcagtttcagatctttcatggtggctgtacagcgttgtgctagcagtgtggctattgttcagcaatactttgcaaactctatatctcggcttttactgcctgtggatggtgcccatgcttcttcctgtgaagaaatggctacagctatgtccagtgcagaaactgctgcttataaagggcttcaaaaatgcattgaaactgtgatggcagaggtggagcggttactatcagctgaacagaaggcaacagattatcggttgcctgatgatggaattgctcctgatcatcggccaacaaatgcctgcactagagttgtggcatatctttctcgtgtgcttgaggctgcattcactgccctagaaggtcttaataagcaagctttcctgactgaattgggaaaccacttgcataaagggctgcttaatcattggcagaagttcactttcaaccctagtggtggactgcgattgaagcgtgatataacagagtatggtgaatttgtgcgcagttttaatgctcctaccgtggatgagaaatttgaattgttgggcattatggccaatgtctttattgttgctcctgaaagtctctccagtttgtttgagggtacccccagcatccggaaagatgcacaaaggtttattcagcttagagaggactacaagactgcaaaacttgcatccagactcagcgccctgtggccctccagttaagcatgctgaaataagcataaatctctcacatctctttgatcatttttacatcctgccgtgacaaactcgaggcagcctgacctctcaagttggacgctctttccggcaccgagatcaaatttggcaactgtaccgagatattaagttaatcgcagggctaaggagcttatcgttagacacatatttgggtacaattgcttccccactagaattatttcccctcattctcttctcttttccgagtgtagattgttgaaagtatggaccgaatcgtattttgtaaggctttaacttatacgctaggctcccatttttccaagatttcatgccctggcatgcccccttgtaatgatcctttccgccatggatgatgacatttaatggtgttttttcgttgcagtcaatacctcgtacttcatcagactgactgtaatggaaattcgtattttcaatttacaagttttggtgtgattgctcaa

SEQ ID NO: 391 - DNA, 1128 bp, Vitis vinifera
cctctggaatccacccaggcggacgacagtgtctcgtttccaactcacagaaggggcaaaaattttttgtagagagagaaatttaactcctccactgtctttcctcttccctcttaatcctaataattaagaaaggaaagcggtggtgctaatggctgggtatagagctgaagatgactacgattacctcttcaaggtggttctgatcggtgattctggtgttgggaagtccaatcttctctccaggtttaccaggaacgagttcagcctcgagtccaagtccacaatcggggtcgagttcgccactcgcagcttgaacgttgatggcaaggtcatcaaagctcagatttgggacactgctggccaggaaaggtaccgtgcaataactagtgcttactaccgaggagctgtgggtgctctgcttgtgtatgatgttactcggcactccacatttgagaatgttgaaaggtggttgagggagttgagggatcacacagatcccaacattgtggtcatgctcattggtaacaaatcggatcttcgtcatcttgtggcagtctcaactgaggatggcaagtcatttgcagagagggagtccctctacttcatggaaacctctgcgctggaagcaacaaatgtggacaatgcatttgctgaagttcttactcagatataccgaattgttagcaagaaagccatggaagctggtgatgatggagctgcttcagctgttcccagcaaaggggagaaaattgatgttggtaaagatgtctcagctatgaagagagttggatgctgctcaaactagggttttgaattgaatttgattgtgttggatgggatgtggccggtttgttttgctgcatctgtttctatatacaccaccatgattgtgtaaaattttctcaaagttgcctacattaggagataggctgattgtctttacatattatttttatttttttacttgagattatttacattattagctgacacagagggcttgattaggagcatgatattctattgttttcagttagatggtggatagggtgaagacttgaaccaaaacttgtttgattcaatgcctgttcagattcatttatctatattgcattattctaatga

SEQ ID NO: 392 - DNA, 1974 bp, Vitis vinifera
ggaatgaatctcagggtgccctgggacctgggcctcatgctgcagatggatggattgctgaatttggacaacacagagcagagcatggtggtcctgatgcttgggctcactcatttgtgcaacaacacggtgctaatggttgggcttctgaatttgagcaggaacaaactcagattgcacaaatgagaggtgcaaatatctcaaacttagctgcaatggagcagactcgaatgcttgcacacacattagctcaaaacaatgaccctaaatttcagaattcaaagtttctccaatttgtgtcaaagatgagtcgaggtgaacttatcattgatgataatcaagtcaagccaggtgcatcatcttcatctggggattgggcaggagaatttcaacagcaatatagtgggggtcttaattgggctgaccaatttgtgcatgatgcgggacctgagagatgggtgaatgagtttactacagaagctaagcagcgtggatcagttgatgacccatgggtggatgaattctctaagttgcatattcaggattgggtggaagaatttgggcagcaggatgaaggggctgctgataactgggcaactgcatatgatgagtacctaaatgagcaagaagcttctaagcagcagtcagacaagtcaaggggtgtttatgtcttttccgatatgaatccatatgttggtcatcccaatcccttgaaagaaggtcaggagctgtttcgcaaagggcttctgagtgaagcagtacttgcattagaggctgaagttctaaaaaacccagacaatgctgaaggttggaggttacttggaatagcacatgcagagaatgatgatgatcaacaggctattgcatccatgatgcgtgcacaagaagttgagccaacaaacctggaagtgcttcttgcgcttggcgtgagtcatacaaatgaattggagcaggcagctgcattgaaatatctatatagttggctacgccatcatccaaagtatgggacccttgcccctatggaacagtctgattctctgtattatgctgatgttgtcagattattcaatgatgctgctcaaatgtcacctgaggatgctgacgtccacatagtacttggtgtcctgtataatttatccagagaatatgacaaagctattgcatcctttcagacggctttgaaactcaagccacgtgattactccctttggaacaagcttggtgcaacacaagctaacagtgttcagagcgcagatgcaatattagcttatcaacaggcactggatttgaagcctaattatgtccgtgcatgggcgaacatgggtatcagttatgccaaccagggtatgcatgaggattctattcgttactatgtccgggcacttgcgatgaatccaaaggcagataatgcctggcaatatttgagaatttctcttagctgcgcgtcccggaatgacatgatggaagcttgtgatgctcggaatcttgatattctgcagaaggagtttcctctttaaaacaattatattcattttggagatgagagaaataatgggggtctgcccttgagatgaggtctgattctaaagcttttgtaggaaagatgcaatccaaggcttgtgacaattccatagcccatggcctgacgttcaggttccatcttttgctgcatttgggtatagtagaaggaagtgttccaatcttgttacggtctgcaacagtggaaaagattaaaggtggcaatttttttttttttttttaaataaaatttgaaagcaccatctctcaagcttcatacagagtgtggttattccatactgatgagatgagaagggaaattgaaaatgagggggccaaataaatgctgataataaaggattgtgaaattccattgtgtttgtacatatgatcaacaacttaatattttagcaacagtggatattccttttttgttggttccctggtatagataag

SEQ ID NO: 393 - DNA, 1058 bp, Vitis vinifera
cttgttaagcagccaaacaaaggttctaatcataattattagtattcattctcacttccctcttccttctccttcacaaatctccactctactttactctctctgcatatttttctagggttttttcggagggaagaggaagcatcagacatggctgggtacagagctgaagatgactatgactacctcttcaaggttgtcttgattggagactctggtgtgggcaagtccaacttgctctctaggttcaccaagaacgagttcaatctcgagtccaagtccactattggtgtagagttcgctaccaggaccttgaacgtcgatggcaaggtcatcaaggctcagatttgggacactgcgggtcaagaaaggtaccgagccatcaccagtgcttactaccgaggagctgtaggtgcactccttgtatacgatgtcacccgacatgcaacctttgagaatgttgacagatggctgaaggaattgaggaatcacactgaccccaacatcgttgtgatgcttgtgggcaacaaatccgatcttcgccaccttgtggctgtctcaacagaagatgggaagacatatgcagagagggagtcactctacttcatggagacttctgcactggaagcgaccaatgtagagaatgcatttgcagaggttctgacccagatataccgcattgtgagcaagaagtcggtggaaggaggagatgaaggagccgcttcatctgtacctgccaaaggggagagaataaatgtgaaagacgacgcgtctgctctgaaaagagtggggtgttgctcagggtaaggtttgggggattgaattgtgtttgggtagatttggcttctttgtttggtgtaatattttctcagggatagacatcagaaggaaactggaaaaagtgatgttcttcataagacattgatttgctgtattggaccgtgatatatgggagcagaataggcacttccattgcttctttgtcttttttttttttttttcccttttcttttcaagtgaatctgtttgacaaatttcataatcaagagtttttgtga

SEQ ID NO: 394 - DNA, 1228 bp, Vitis vinifera
agggaacaacataggaacgacaaagcatccaacctaatcaaacgattcaaaccaaacgaaatcgaaggagatttggatcggatccctgaaggaaccacatctccctcgctaccttcattttcatctccatccaatggcctcttacagagccgacgacgattacgattacctcttcaaggttgttctcatcggcgactccggagtcggcaaatccaatctcctctcccgcttcactcgcaacgagttcagcctcgaatcgaagtctaccatcggcgtcgaattcgccacccgcagcattcgtgtcgatgataaggtcgtcaaggcccagatttgggacaccgctggccaggagagatatcgagcaattacaagtgcatattatcgaggagctgttggtgctttacttgtttatgatgttacccgtcacgtaacatttgaaaatgtggagagatggctgaaggagcttcgggatcacacagactccaacatcgtgatcatgctcgttggtaacaaggcagatctccgccacttgcgagctgtttccactgaagatgctaaggcttttgctgaaagagagaacaactttttcatggaaacatcagctctagagtccatgaatgttgagaatgccttcacagaggtgctgacccagatctatcgtgttgtcagcaggaaagctcttgacatcggggatgacccagcagctttgcccaagggacagaccatcaatgttggaaccaaggatgatgtatcggcagtgaagaaagtgggatgctgttctgcataatactgaagaaacaaggatctagttttgaagaacatcatgtttggagctttctatcctgttcatatttatatagagcatggccctgcatcgcacacgaaagctatgtcaacaaaacttttaactgttagaacatcatgttctggatacttgaacagatcttttgtttatggttagccaaaggtttaggatctaaaggaaacggagcagctcgctgacattttctttgattcattttagctttcaatttccattctttcccatcggtgtactgctataattgctccattaacatagcttcatatttgagtagctgttttgggttataatttgtactcaagtctttgaatttctgtttaaatgcttagctatttacttgattcataaaagtgacattattttcctctactcaatgcatttaatatactagttaagtttcgccta

SEQ ID NO: 395 - DNA, 500 bp, Vitis vinifera
agaaggagaggagtatctcttcaagattgtaatcatcggggattctgcagtgggcaaatccaatttgctctctcggtatgctcgcaacgagttcgatctccactccaaggccaccatcggagtggagttccagactcagtgcgtcgacatcgacggcaaggaggtgaaggcgcagatctgggacaccgccggtcaggagcgcttcagagccgtcacctctgcttactaccgcggcgctttcggtgctctgctggtttatgatatcagccgccgctccacctttgagagcatcgcgcgttggcttgatgagctcaagatacattgcgacacgacagtggcgaggatgctggtaggcaacaaatgtgatttggagaatattagggatgtgagcactgaggagggaaaaaacctggcagaagcagaaggattatttttcatggagacatctgcacttgatgctactaatgttaaaacagcttttgagatggttatccgggaaa

SEQ ID NO: 396 - DNA, 699 bp, Ipomoea batatas
atttatctctatatctctggtctcgtcatcggaattgcaatcttctccacgcctttatctcaaccctagatttcctcaatcgatcgatcgatctctctgctccttctgaagtcatggctaatgcagcatctgggatggctgttcatgatgactgcaagctgaagtttttagaactgaaggcaaaaagaagtttccgcttcgtagttttcaagattgaagagaagcagaagcaggtgattgtagaaaaacttggtgagcccgcacaaagctatgaggacttcgctgccagccttcctgcagatgagtgtcgctatgctgtctacgactttgattttgtaaccaaggaaaattgccagaagagcagaattttcttcattgcttggtcacccgatacagctagggtgagaagcaagatgatctatgcaagctccaaagataggttcaagagagagcttgatggcatccagatagagttgcaagccactgaccctactgaaatgggccttgatgtcatcagaagccgagccggctgcagttgaattgctgttccctggaatggagagctatccataaagttttctttggttatgtctaatgtttatattatgctgggaagtagaattggttaagatatgctgttcggtcaaaccttttaaagcttcatctccgatgagaaacttaaatgatttttaagcatac

SEQ ID NO: 397 - DNA, 969 bp, Ipomoea batatas
ggattgtactgaaacagctttgagtagatctccctcctctctccttcaaacgttgcggccccccttcttcctccttcagtccttcagattcatcactctctctttctctgcatacacacacacatatacagagagagggaagggagagctactcctccaccccctggcagtgtacagcgtaatagataggtacggagaatgggggcgtacagagcggacgacgattacgactacttgttcaaggtggtgctgatcggcgactccggcgtcgggaaatccaaccttctctccagattcactcgcaacgagttcagcctcgagtctaagtccaccatcggcgtcgagttcgccactcgcagcatccgcgtcgacgagaaggtcgttaaggctcagatttgggacaccgccggccaggaacgatatcgtgcaatcacaagtgcctactatcgaggagctgttggtgcattgcttgtctatgatgtcactcgtcatgttacctttgaaaacgtggagagatggttgaaggagctccgcgaccacacagattccagcatcgtcatcatgctcgtgggaaacaaagcagacttgcgccacttgcgagctgtttcaaccgatgatgccaaggcatttgctgaaagagagaccacttttttcatggaaacctctgccctggagtccatgaacgtggaagacgccttcacagaagtgctcactcaaatataccatgtcgtcagcaagagatctcttgaagccggggacgaccaagcaactttgcccaagggacagacgattagcgtcgggagtaaagatgatgtttcagcagtaaagaaggccggttgctgctctgcttagaggctagagcagatacctaatcctatggcagttgaggttctttttgtattcagttatatccttgtgttgctattgaacacttccaattatatataaaattgacaggccattaaagtt

SEQ ID NO: 398 - DNA, 929 bp, Ipomoea batatas
ggccggggatccagatttcttcaggcacgaaagttgaaaggcacacttttcttcttcttcttcttcctattcagaatctctcgcctgcctccagatttctctctagcgtctatcttaggatgtcgatctttgagtacaacggaagtgccctagtggcgatggtggggaagaattgcttcgccattgctagtgaccggcggctcggtgtacagctgcagaccgtcgccactgatttcgagaggatttacaaaatccacggcaagctctttctcggcctcgccggcctcgccaccgatgtccaaactctgtatcaacggcttgtattccgccacaagttatatcaacttagagaagagagagatatgaagcccgagacttttgccagccttgtatctgcaatcttatatgagaaaaggtttggtccatacttctgccaacctgtgattgctggattgggagatgaagacaagcctttcatttgtactatggattctattggagcaaaagagcttgccaaagattttgttgttgcgggtactgcctcagaatcactgtatggtgcctgtgaagcaatgttcaagcctgacatggaacccgaggaattgttcgagacaatctctcaagcactcgttgcatcagtagaccgtgactgtttgagtggttggggaggacatgtttatgttgttaccccaactgaagtaacagaaagaatcttgaagggcaggatggactaaacactttcttcatgggggtctattagcttcatgtttttctgtcatttcctccattgcaatgaatcatgtttctgtcactctcttaaactctgtgtcgaatgcttctagtctgagttctgttgctttcttattactttaaaaggtcccattactccatttcagtactgtaaaactaattcgaattcagtcaaatca

SEQ ID NO: 399 - DNA, 944 bp, Ipomoea batatas
aaaaacacaactttgaaaactaactcacaacactaacaaaagggaaaagaaaagaaaagaaaaagagttggggctgtggtgttgtagaagctaagtggatgatggctgggtatagagctgaagacgactacgattatctattcaagttggttttgattggggattcgggtgtgggcaaatccaacttgctctcaagattcaccaggaacgagttcagcctcgagtccaagtccaccattggcgttgagttcgctaccagaagcttgactgtggatgccaaagtcatcaaggctcaaatttgggacaccgctggccaagaaaggtaccgggcaatcactagtgcatactacagaggtgcggtgggtgctttgctcgtgtatgatgtcacccgccactcgactttcgaaagcattgagaggtggctcaaggagttgagagaccacacggatcccaacatcgttgtcatgctcgttggcaacaaatctgatctccggcacctcgtggcagtgtcaacggaggacgggaggtctctcgcggagagggaatccctctacttcatggaaacttcagcactcgaagccactaacgtggagaacgctttctctgaagttcttgcccaaatctaccacgtcgtgagcaagaaagccatggagagcggcgagaatggaacggcttctgctgtcccttcgaagggcgagaaaattgatattggtaaagatgtatctgcagtcaagaaaagcggttgctgttcttgaacacttccaagcaagttaagttaagctgcattaatggtggaatgtgtattgctgcatgtttctatatatgtacacccatgttgttttgaacatcctaggcttttagttacagtctttctagtattttcttcattcacttcatagaaggaatgtaatttattcagtggattccattaacatctgattcat

SEQ ID NO: 400 - DNA, 899 bp, Ipomoea batatas
tcatcgcagtctggaacagcgataactcgaggaagtcggtttccttctctggttggcaaagtctctcttgggtcctaattcagtacagcgaaaatggctaatgcagcttctgggatggcagtgcacgatgactgcaagttgaggttcttggagctgaaagcgaaaagaacgcaccgttttattgttttcaagatcgaggagaagcagaagcaggtcattgtcgaaaaggttggtgagccagcgcaaagctacgaggatttcaccgctagccttcctgctgatgaatgccgatacgcagtttatgattttgatttcgtgacagcggagaactgccagaaaagcaagattttcttcatcgcatggtcccccgacacatcaagggttaggagcaagatgatatacgcgagctccaaggatagattcaagagggagctcgatggaattcaggtggaactccaagcgaccgacccgactgaaatgggtatggatgtgattagaagccgcgctaactagatgcagcagagagagatggatcgatagacttctgatagacattgtaagggagaactcactgcagtcttctttactcggtcaaaatgtttttatggtttgtgaaagggaaaaacttggctaccgataatatttgattgccaagggctaccatatgatcttcttcttctatttattttgaacaaaatttgtggtgtctggtatatgagttgatgatttgttgcctcaaaaattcattgtgtgtgcctcactaatagtttgatgcctatgatccataatgtaaagagcttgcaagggggatagatgctacttttagtttccctttttttgcctttatagtagttcatctgatatttcaccctagctctgtcttgtgatcagatcagaaa

SEQ ID NO: 401 - DNA, 1073 bp, Ipomoea batatas
ttagtctatatgttacagaaggccttgagagggccagggatagccttactgaagctgcagctttaagggaaagatttgtgttgggaacaagtgttagtcgaagggttgctgcagcagctgcttctgctgcggaagcagcagctgctgctggtgaaagcagtttcaaatctttcatggtggctgttcaacgttgtggaagcagcgtggctattgttcagcaattttttgccaactctatttcccggcttttgttacctgtggatggtgcccatgctgcttcatgtgaagaaatggcaaaggcaatgtccagtgcggaaggtgctgcttataaggggcttcaacaatgcattgaaactgttatggctgaggtggaacgtttgctatcaacagaacaaaagacaacagattttcggtcacctgatgatggcattggcccagatcatcgaccaacaactgcctgtacaagagttgttgcatacctatcccgagtgcttgaatctgcatttactgggcttgatgggctaaataaacaagctttcctcactgaactgggcaatcgccttcacaaagggttgcttaatcattggcagaagtttaccttcaatcctagtggaggactccgcttgaagcgtgatataactgagtatggagagtttgttcgtagtttcaatgccccctcagttgatgagaaatttgaattgctgggcatcatggcaaatgtctttattgttgctcctgaaagcctttcctctctgtttgagggaaccccaagtattaggaaagatgcgcagaggttcattgagcttcgggatgactacaaaagtgcaaaacttgcatctagatttagctccttgtttggctagaactcgatactaagcgatatgtgtgtagaggcaatgtaactctaaagactgcttcggctcacaatgttgttatgtttgtacctagtactgaatgcattgggcattttgcaagtgatgattggctcacaatgttgttatgtttgtacctagtactgaatgcattgggcattttgcaagtgatgatttgacagtttctgtaagtgagaggat

SEQ ID NO: 402 - DNA, 739 bp, Ipomoea batatas
tatttcctgcgtactcccccaaatctctcttctgtggttctgatttcagataacaaaaaaatgtcttccagaggggcaaatgcatcctccgggatgggagttgctgaacacagcaaaagcacgtacatggaattgcaaagaaagaaggtgcaccgttacgtgatctttaagatagatgagaagaagaaagaagttgtggttgagaaaaccggaggtctagctgaaagctacgacgattttaccgcatctttgcccgagactgattgccgttatgctgtctatgactttgattttgttacttccgagaactgccaaaagagcaagatatttttcatcgcatggtccccctcggtttcgaggatccgttctaagatgctatatgcgacatccaaggacaggttcaggagggagctccaaggcatccactacgagatacaagccactgaagcaacggaggtggatcttgaggtgctccaggagcgtgctaattgatcgtatcgtgaaaggggttttcgatctacgttcatgacttatatgtatgtggaataataatgtggcatctggtaacgctgaacaggagctcattgttatgataaaagtatggttacaggcagggctccttattctcatgatggtttccagatgactagttgttttgactatcaactatgtgccctttataggcatatattatggacactactgaatactgatatgtatatgttgtcacctggctacc

SEQ ID NO: 403 - DNA, 959 bp, Ipomoea batatas
  misc_feature (897)..(897): n is a, c, g, or t
gcgaaatctttgattcttttccttacagataaagattacgggctgctgcgtttactctctctgtaacccagaacttcttcttctcttctgagcaagaaagagagagagagagagagagggaatgggggaggaagaaggggaggagtaccttttcaaggtggtagtaatcggcgactcggcggtgggcaaatccaacttgctatcgcggttcgccagggacgagttcgaccacaactccaaagccaccattggagtggagttccagacgcaggtggtggaggtcgacggcaaggaggtgaaggcgcaggtctgggacaccgccggccaagaacgcttccgcgccgtcacctccgcgtactacagaggcgccgtcggcgccctcattgtctacgacatcacccggaagacaacctttgagaacatcaaacgctggctcgaagagctcaacactcattgtgatactacggtggcaaggatgctggttggaaacaagtgcgatttggagagcattcgggatgtgagcgtggaagagggcaagctccttgcagaagaggaagggttgttcttcatagagacgtccgccctcgactccaccaacgtcaacaccgcctttgagattgtcattcgcgacatctacaagaacgttagcaggaagctgctcaactccgactcctacaaggccgagctgtctgtaaaccgggttagcctcgcgaatggagctgacatgtcgaagcaaaacaagagcagctacgcgtgctgctcctcctcctcctagtaattttgttttgttttcccacgttgttttagctgtatgttagacttttggatgtatgtttattctttttgatgaattagggcaatgagggtctctgaggttgccttatggaatggcatatntattgtatgtttcttggtcaggccagtgaagtttcaaagatgcagcagaacaagttaacatg

SEQ ID NO: 404 - DNA, 850 bp, Ipomoea batatas
aagtcggttttccttctctggttggcaaagtctctcttgggtcctaattcagtacagcgaaaatggctaatgcagcttctgggatggcagtgcacgatgactgcaagttgaggttcttggagctgaaagcaaaaagaacgcaccgttttattgttttcaagatcgaggagaagcagaagcaggtcattgttgagaaggttggtgagccagcgcaaagctacgaggacttcaccgctagccttcccactgatgaatgccgatatgcagtttacgattttgatttcgtgacagcagagaactgccagaaaagcaagatcttcttcatcgcatggtcgcccgacacatcaagggttaggagcaagatgatatacgcgagctccaaggacagattcaagagggagctcgacggaattcaagtggaactccaagcaaccgacccgactgaaatgggtctcgatgtcattagaagccgcgctaactagatgcagcagagatcgatagacttctgatagacatagtaagggagaactcacctgcagtcttctttactcggtcaaatgtttttatggtttgtgaaagggaaaaacttggctaccgatagataatatttgattgccaagggctaccatatgatcttcttctatttattttgaacaaaaatttgtggtgtctggtatatgagttgatttgttgcctcaaaattcgttgtgtgtgcctcactaatagtttgatgcctatgatccataatgttaaagagcttgcaaggggatagatgctacttttagtttccctttttttgcctttatagtagttcatctgatatttcaccctagctctgtcttgtgatcag

SEQ ID NO: 405 - DNA, 843 bp, Lactuca sativa
gcggggaattgaggcagcagacacgtctttctcggtcgttgcaaaacaccctaacatttctgaatcggagccctaaattttctcgatcgtttttgttcatcaccctccttcgcctgaaatcatggccaatgcagcatcagggatggctgtgcatgatgactgcaagctaaagtttatggacttgaaggcaaaaaggaccttccgtttcatcatttataagatcgaagagaaacaaaagcaggtgatggttgaaaagcttggagaaccagcggaaacttatgatgattttgcagcatgtctccctgctgatgaatgccgatatgctgtctttgattttgatttcatgactgcagaaaatgtcccaaaaagcaggatcttcttcatcgcctggtcacctgatactgcaagagtgaggagcaagatgatttatgcaagctcaaaggacaggttcaagagagagcttgatggcattcagattgaattgcaagcaaccgatcccaccgaggttgggcttgatgttattagaagccgagcaaattaaacatctaaaatttcaaatggagatgacgaggattcttcatagaatattgtgattttatgttaaatgtttatagttgtttctggtatggtatgtagtatcagtatcagtacgaacgagtaccagttgttactttcctcaaaagtcttgctttccgtcaagaaccagtgtgatttcaggtaaaaaaatttgtgtgatgttttgtgtgattcaagtattcaacacaagtaatatgggatttgtattgtatttcaatttcaatttcatttcatttcatttcatttcttacaatcatattaatgcta

SEQ ID NO: 406 - DNA, 2832 bp, Lactuca sativa
gcggggatgagtcttcgcggtcaggctccgtctactgttcttcatctgttttctgcacccgctcgatctaatatttcaacttaagaacacgaagaagaaggatttctttcaggaagatcaaagtaggagtctgtgcttaacttgatctccaacgagatgaaagagattagagatggaacaaaaagtaacaaaatatctcaaccacttgttttagacatagaagacttcaagggcgactactctttcgatgctttatttggaaacttagtaaatgaggttctgccatctttccaagaagaagatgctgactcattagaagcaaatggtaatattaatgggaatgatgctttgcctaatggaagggcagggcaaggtcaagggcaagggcaattgactcctttatttccagaagtagatgctttattgtcaatgttcaagaattcctgttcgcagttagtcgaaattcggaaacaggttgatggaaaactatttaatcttaaaaaagatgtttctgcacaagactctaaacataggaagacgcttggtgagctggagaaaggtgtggatgggttgtttgatagctttgcaagattggattcacgtatttctagtgttgggcagactgctgctaaaattggggatcatttacagagtgcagattcccagagagaaactgccagccaaactatggagctcataaagtacctaatggaattcaacagtagcccaggggatctgatggaactttctcctctattctctgatgacagccgtgttgctgaggctgcttcgattgcacaaaaattacgttcatttgcagaggaagatattggcagacagggtgtgactatgcaatccgttccagggaaatgcactgctagtagaggaytggaggttgctgttggcaaccttcaagaatactgcaatgaactggagaacagattgttgtctaggtttgatactgcatctcagaaaagagaattgtcaaccatggcagaatgtgcaaaaatcctatctcagtttaacagaggcaccagtgcgatgcaacactacgtgggtttaaggccgatgtttgatgtggaggtgatgaatgcagacacacgattggttcttggtgaccaggattccctacctagtcccagtaatgttgcccgtgcactctcctctttgtacaaagagataatcgatactgtccgaaaagaagcagctaccatcacggctgtatttccttctccaaatgatgtcatgtcaattttggtacagcgagtaatggaagatcgggttcctaaactgttggagaaactgttggtgaagccatctttagtgcatccacctccgatgggagaaggtggtcttttgctatacctgaggatgttggcagtgggatatgagaagacacaggaacttgccaaagatctacgcagtgtgggatgtggtgacttggacattgaaggcctaacagaatctctattcattgatcacaaagatatgtacattgaatacgagcaagcttccttaaggcaactctacaaatcaaagatggaggaactgctttctgaaagccagctatcgggagagtcaacagggtcaattggacgttcaaaaggtgcttcaatatcatcatcccaccagcaaatatctgttacagttgtcacagagtttgtgcgctggaacgaagaggcaatttccagatgcactttgttttcacctcagcctggtaatcttgcaaccaatgtgaaaaccgtcttcacttgccttctagaccaagtgagtcagtatacaacagaagggcttgaaagagccagagacggcctcacagaggctgcagctttgagggagaggtttgtgttaggcaccagtgttagccgtagagtggctgctgctgctgcttctgctgcagaagctgctgctgctgctggtgaaagcagttttagatctttcatggttgctgtacagcgttgtggaagcagtgtggctatcgttcaacaatactttgctaactcaatttcaaggcttctgttacctgtggatggtgcacatgctgcatcatgtgaagaaatggcaacagctatgtccagtgcagagggcgctgcctataaaggcctccaacagtgcatcgagacagttatggccgaggtggaacgattgctttcagccgaacaaaaagcaaccgattataaatcaccagatgatggcattgttcctgatcatcggcctacaaatgcatgcataagagttgtggcatacctctctcgtgtgcttgaagcagcattcactgcattagaaggtcttaacaagcaagctttcttaactgaattggagaaccgcttgcacaaaggcctaagtaatcactggcagaagtacactttcaatcccagtggaggactaaggctgaaacgtgacatcactgaatatggggatttgtagaagyttcatgctcctacagttgatgaaaaattcgaatcactaagcatcatggcaaaygtcttcatygttgctcctgaaagcttatcgagtctgtttgaaggcacaccaagcatacttaaagatgctcaaaggttcattcagcttagagaggactataaaagtgcaaaacttgcagccaaactcagctccctttggccaacctcttaatctagttgttgtagattttattagtatamaatgcatttwcaaatttractcttgtgagttatattacatgtttattattattggagttttgcacaactacttgcatatggtaaaattggttccagacagacatccttttgtttacctctttgctgtctgagtgtgtattatttctataaatcttacattatttttttt

SEQ ID NO: 407 - DNA, 977 bp, Lactuca sativa
gcggggacatcattgttcttttagggtttgaagtgcaaattggtaaaacgtcaggggggtctctaaaattcgaacttgttaaaaagagagaggactccgaaaaatccccaaattgaggcagcagacacgtctttctcggtcgttgcaaaacaccctaaaatttctgaatcggagccctaaattttctcgatcgtttttgttcatcactctccttcgcctgaaatcatggccaatgcagcatcagggatggctgtgcatgatgactgcaagctaaagtttatggacttgaaggcaaaaaggaccttccgtttcatcatttataagattgaagagaaacaaaagcaggtgatggttgaaaagcttggagaaccagcagaaacttatgatgattttgcagcatgtctccctgctgatgaatgccgatatgctgtctttgattttgatttcatgactgcagaaaatgtcccaaaaagcaggatcttcttcatcgcatggtcaccggatactgcaagagtgaggagcaagatgatttatgcaagctcaaaggacaggttcaagagagagcttgatggcattcagattgaattgcaagcaaccgatcctaccgaggttgggcttgatgttattagaagccgagcaaattaaaaaaaaaaaaaacgagctctgttataaatttcaaatggagatgacgattcttcatagaatatttgtgattttatgttaaatgtttatagttgttctggtatggtatgtagtatcagtatcagtacgatcgagtaccagttgttactttcctcaaaagtcttgctttccgtcaagaaccagtgtgatttcaggtaaaaaaatttgtgtgatgttttgtgtgattcaagtattcaacacaagtaatatgggatttgtattgtatttcaatttcaatttcatttcatttcatttcttacaatcatattaatgctattatgctggaatcaccattt

SEQ ID NO: 408 - DNA, 885 bp, Lactuca sativa
gcggggatcggatcaataacccccattctgcaactctcaccgatatcgcctgtgttgtggttttcatcctcttcgggtcgatgtcgatttttgagtataatggaagcgccctggtcgccatggttggtaagaattgcttcgcaatcgctagcgatcggcgtctcggggttcagctccagactatagccactgatttccaaagaattttcaagattcatgataagctctttctcggtctctctggtctcggcagtgatgctcaaacacttcatcaaaggcttktatttcgccayaaactgtatcagcttcgtgaagaaagagatatgaagcctgaaacttttgctagtcttgtctctgctgttttgtatgagaaaagatttggtccttatttctgccaacctgtgattgctggattgggagaagatgataagccattcatttgcacaatggactctattggagcaaaagagcttgcaaaagattttgttgttgctgggactgcctctgagtctctttatggtgcctgtgagtcgatgttcaaaccggatatggatcacgaggatctgtttgagacaatctcccaagctcttttatcatcggtggatcgtgattgtttgagtggttggggaggccatgtctacattgtcacaccgactgaagtgacagaaagaatcttgaagggaagaatggattaacaaatattatataatttttttttttattaatctggagaattttattatctttgtatgatgcaatttaatccgttctatctcttctacttgttccttaacacctaaccttcaagcgtgataattttctcaattgcttaatatatctgagacacatttcttcaaaatcaatraccaaatagtgatgatatcc

SEQ ID NO: 409 - DNA, 834 bp, Lactuca sativa
gaattcggccttatggccgcttgacgggggctacacaaaatcctctttcatttcaccaaatcatcttctcccctttcgatgtcgatttttgagtacaatggaagcgccctggtggccatggtcggaaaaaattgctttgctatcgccagtgataggagactaggggtccagcttcaaactatcgcaactgatttccaaagaattttcaagatccatgataagctctttctgggtctctccggtcttggctctgatgctcaaacacttcatcagcgacttgtgtttcgccacaaactgtatcaacttcgggaagaaagagatatgaagcctgaaacttttgctagtcttgtctctgctgttctgtatgagaaaaggtttggtccttatttctgtcaacctgtgattgctggattgggagatgatgacaagccatttatttgcacaatggactcaattggagcaaaagagcttgcaaaagattttgtggtggctggaactgcttcagagtctctttatggtgcttgtgagtcaatgttcaagcctgacatggaacatgaagagctgtttgagaccatctcccaagctcttttatcatctgtagaccgtgattgtttgagtggttggggaggacatgtgtaccttgttacaccaactgaagtgactgaaaggatcttgaaaggaagaatggattagagttttctttatcaaaaaaatcctatttagcccttgaactttttggatttcaattgtatttggtggcttattttaaaagttaatcgatattcagacttttatggtattgttgtgtaacgcttatcttcagtcattctcatt

SEQ ID NO: 410 - DNA, 859 bp, Lactuca sativa
gaattcggccttatggccgcttgacgggggctacacaaaatcctctttcatttcaccaaatcatcttctcccctttcgatgtcgatttttgagtacaatggaagcgccctggtggccatggtcggaaaaaattgctttgctatcgccagtgataggagactaggggtccagcttcaaactatcgcaactgatttccaaagaattttcaagatccatgataagctctttctgggtctctccggtcttggctctgatgctcaaacacttcatcagcgacttgtgtttcgccacaaactgtatcaacttcgggaagaaagagatatgaagcctgaaacttttgctagtcttgtctctgctgttctgtatgagaaaaggtttggtccttatttctgtcaacctgtgattgctggattgggagatgatgacaagccatttatttgcacaatggactcaattggagcaaaagagcttgcaaaagattttgtggtggctggaactgcttcagagtctctttatggtgcttgtgagtcaatgttcaagcctgacatggaacatgaagagctgtttgagaccatctcccaagctcttttatcatctgtagaccgtgattgtttgagtggttggggaggacatgtgtaccttgttacaccaactgaagtgactgaaaggatcttgaaaggaagaatggattagagttttctttatcaaaaaaatcctatttagcccttgaaccttttggattttgtttgtattttggtggttgttttttaattttaaaaggtggttttgtgcacaagttaatcgatattcagacttttatggtattgttgtgtaacgcttatcttcagtcattctcatt

SEQ ID NO: 411 - DNA, 802 bp, Lactuca sativa
aattgaggcagcagacacgtcttctcggtcgtcgcgaaacaccctaaaatatctcaatcggagccctaaattttctcgatcgttttcgttcatcattctccttcgcctgaaatcatggccaatgcagcttcagggatggctgtgcatgatgactgcaagctaaagtttatggacttgaaggcaaaaaggacccatcgctttatcatttataagattgaagagaaacagaagcaggttatggttgaaaagcttggagaaccagcagaaacctatgaagattttgtagcatttcttcctgctgatgaatgccgatatgctgtctttgattttgatttcatgactgcagaaaatgtcccaaaaagcaggatcttcttcattgcatggtcacctgataccgcaagagtgaggagcaagatgatttacgcaagctcaaaggacaggttcaagagagagcttgatggcattcagattgaattgcaagcaactgatcctactgaggttggacttgatgttattagaagccgagcaaactgaaaaaaagctctgctataaatttcaaatggagatgacgattcttcatagaatattgtgattttatgttaaatgtttatagttgttctgggatggtatggtatgtagtatcagtatcagtacgagtaccagttgttactttcctcaaaagtcttgctttccgtcaagaaccagtgtgatttcaggtaaaaaaaatttgtgtgatgttttgtgtgattcttcaacacaagtaatatgggatttgtattgtatttcaatttcatttcatttc

SEQ ID NO: 412 - DNA, 820 bp, Lactuca sativa
tcgatgtcgatttttgagtacaatggaagcgccctggtggccatggtcggaaaaaattgctttgcaatcgccagtgataggagactaggggtccagcttcaaactgtagcaactgatttccaaagaattttcaagatccatgataagctctttctgggtctctctggtcttggctctgatgctcaaacacttcatcagagacttgtgtttcgccataaactgtatcaacttagggaagaaagagatatgaagcctgaaacttttgctagtcttgtctctgctgttctgtatgagaaaaggtttggtccttatttctgccaacctgtgattgctggattgggagatgatgacaagccatttatttgcacaatggactcaattggagcaaaagagcttgcaaaagattttgtggtggctggaactgcttcagagtctctttatggtgcttgtgagtcaatgttcaaacctgacatggaacatgaagagctgtttgagactatctcccaagctcttttatcatctgtagaccgtgattgtttgagtggttggggaggacacgtgtaccttgttacaccaactgaagtgactgaaagaatcttgaaaggaagaatggattagggttttctttatcaaaaaaaaaaaaaaaatcctatttagcctttgaaccttttggatttcgattgtatttggttgcttattttaaaaggtggttttgtgcacaagttaatcgattttcagacttttatggtattgttgtgtaacgtttatcttcagtcattcctctccaagtatatgctcttttaagtgcaattttatatca

SEQ ID NO: 413 - DNA, 820 bp, Lactuca sativa; identical to SEQ ID NO: 412

SEQ ID NO: 414 - DNA, 791 bp, Lactuca sativa
gaggcagcagacacgtcttctcggtcgtcgcgaaacaccctaaaatatctcaatcggagccctaaattttctcgatcgttttcgttcatcattctccttcgcctgaaatcatggccaatgcagcttcagggatggctgtgcatgatgactgcaagctaaagtttatggacttgaaggcaaaaaggacccatcgctttatcatttataagattgaagagaaacagaagcaggttatggttgaaaagcttggagaaccagcagaaacctatgaagattttgtagcatttcttcctgctgatgaatgccgatatgctgtctttgattttgatttcatgactgcagaaaatgtcccaaaaagcaggatcttcttcattgcatggtcacctgataccgcaagagtgaggagcaagatgatttacgcaagctcaaaggacaggttcaagagagagcttgatggcattcagattgaattgcaagcaactgatcctactgaggttggacttgatgttattagaagccgagcaaactgaaaaaaagctctgctataaatttcaaatggagatgacgattcttcatagagtattgtgattttatgttaaatgtttatagttgttctggtatggtatggtatgtagtatcagtatcagtacgaacagagtaccagttactttcctcaaaagtcttgctttccgtcaagaaccagtgtgatttcaggtaaaaaaaatttgtgtgatgttttgtgtgattcttcaacacaagtaatatgggatttgtattgtatttcaatttca

SEQ ID NO: 415 - DNA, 819 bp, Lactuca sativa
aaatcctctttcatttcaccaaatcatcttctcccctttcgatgtcgatttttgagtataatggaagcgctctggtggccatggtcggaaaaaattgctttgctatcgccagtgataggagactaggggtccagcttcaaactatagcaactgatttccaaagaattttcaagatccatgataagctctttctgggtctctctggtcttggctctgatgctcaaacacttcatcagcgacttgtgtttcgccacaaactatatcaacttcgggaagaaagagatatgaagcctgaaacttttgctagtcttgtctctgctgttctgtatgagaaaaggtttggtccttatttctgtcaacctgtgattgctggattgggagatgatgacaagccatttatttgcacaatggactcgattggagcaaaagagcttgcaaaagattttgtggtggctggaacagcttcagagtctctttatggtgcttgtgagtcaatgttcaagcctgacatggaacatgaagagctgtttgagaccatctcccaagctcttttatcatctgtagaccgtgattgtttgagtggttggggaggacatgtgtaccttgttacaccaactgaagtgactgaaagaatcttgaaaggaagaatggattagggttttctttatcaaaaaaatcatatttagcccttgaaccttttggattttgtttgtattcggtggcttattttaaaaggtggttttgtgcacaagttaatcgattttcagacttttatgctattgttgtgtaacgcttatcttcagtcattcctctccaagt

SEQ ID NO: 416 - DNA, 393 bp, Lotus Japonicus
cgccatggttggcaagaactgcttcgccattgccagtgatcgcagactcggcgttcagctccaaaccgtagccaccgatttccaaaggatcttcaaagttcacgacaagctcttcatcgctctctctggtctcgccaccgatgctcagacactgtaccagcgtctcgttttccgacacaagctttatcagcttcgtgaagagagggatatgaaaccagagacctttgcaagcttggtctctgctcttctttacgagaaaaggtttggtccatacttttgccagcctgtaattgccggattaggggatgaagacaaaccattcatttgcacaatggattgcattggaacaaaagaacttgcaaaagattttgttgttgctggcagtgcatctga

SEQ ID NO: 417 - DNA, 842 bp, Lotus Japonicus
gaagaactggttatcatcgtgttgttgttgcaatcaaatcaaatcaaatcaaatcaaacgatgtcgatcttcgagtacaacggaagtgccctagtggctatggtgggcaagaactgcttcgccattgccagcgatcgaaggctcggtgtgcagctccagaccatagccaccgattttcagaggatttccaagattcacgacaaactcttcatcggtctctctggtctcgccaccgatgctcagacactgtatcagcgtctcgtttttcgccacaaactgtatcagcttcgtgaagagagggatatgaagcccgagacctttgccagcttggtctcttcgattctctacgagaaacggttcggtccatacttttgccagcctgtaattgctggattaggggatgaagacaagccattcatttgcacaatggattgtattggtgcaaaggagcttgcgaaagattttgttgttgctggcagtgcatctgagtctttgtatggtgcttgtgaggcgatgtttaagcctgacatggaacctgaggagttgtttgagaccatctcccmagcmctgctatcatccgtagatcgcgactgtttaagtggctggggaggtcatgtctacgtcgtcacaccmacmgaagtaaaggaaaggatattgaagggaaggatggattaaattcatcgrtcmaccmcttcmaatcactttgttttctgtttaatttagagctgaattccccccctctgttgttaatgaacttacctgaaaattatttaccaaagggttccattgttctgtatttagattatccagataaagtagattctggagtggggcctgttgtg

SEQ ID NO: 418 - DNA, 875 bp, Zea mays
aagaagcccaacccggcctccatgataagcccaccaggccaccgccgtcgccagtcgctacttcccctccgatcctcgtcgccgacgcatccacccgaaccctcctccgcgacctcgccgtcgccgcagccttggccatgtcgatcttcgagtataatgggtccgccgtggtggcgatggtggggaagaactgtttcgcgatcgccagcgaccggcggctgggcgtgcagcttcagaccatcgcgacggacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagacctttgccagccttgtctctgcgctcctctacgagaagagattcgggccatatttttgccagccagtcattgctggacttggagatgacaacgtaccatttatttgtactatggactgcttaggtgcaaaggagctggccaaggattttgttgtatctgggacagcatcagaatctttgtatggtgcttgtgagtccatgtacaagccgaacatggaacctgatgaactcttcgaaactgtatcccaagctctgaattcatcaatagaccgtgactgccttagtgggtggggtggctatgttctgattgtgacaccgactgaagtgagggagcatgtgattaagagcaggatggactaaatcatggccactatcactataattcttagctggtttccaatgcttagaccaatgttgtgtttggattctgaagtaacattgtatcatcacagctggtatgagaatgaacggttgttttattta

SEQ ID NO: 419 - DNA, 1076 bp, Zea mays
ataacccatagtacggataggcccagcatccagtyacagtccggagtccggttggtactccgcaagttcgttttttttacgccggcggaaatcaacctgcgccgctgccttctccgttctcgccgtcgcctccgcctccgctgccgccgcgcaggtcagggtcatgtcgatcttcgagtacaacgggagcgccgtggtggcgatggtggggaagaactgcttcgcgatcgccagcgaccgccgcctcggcgtgcagctgcagacgatcgccaccgacttccgacgggtgttcaaggtccacgacaagctctacatcgggctctcggggctcgccaccgacgcccagacgctgtatcagcggctggtgttcaggcacaagttgtaccagctgatggaggagagggacatgaagcccgaaacctttgccagccttgtttcagccctcctctatgagaaaaggtttggaccatacttctgccaaccagttattgctggcctaggagacaacgatgagccgtttatatgtaccatggactgcattggtgccaaggaactagcaaaagattttgtggtctccggtactgcttcagagtcactttatggtgcttgtgagtccatgtataagccaaacatggaacccgaagaacttttcgagacaatctcgcaagcattgcaggcatctgttgatcgcgactgcctcagcggctggggaggttatgttcttgttgtcacacacactgaagtgcaggagagagtgctgaagggaaggatggactgatgagtgctgccatgtagttattctaggagagattgtttcttcattcgccctgacatactcgcccctgtcctacggcgtacagaattcagagaacctgtgcaccacgtttacttctcattctgaatgaacattgattcagtagttgccttcgcctttaatttctatgctgcttccgcctcagcattttggaattgcatggcttgtggcacttcagttctggtgatggacggcatacctgtttgaccagttaacagggacgtccgtgccgcacgggtttgtcttggaagaatgacagttt

SEQ ID NO: 420 - DNA, 1675 bp, Zea mays
attctatgtccttccagtttgtttcaaagatgagccgaggtgaacttattatagaagataatcaagtaaaagaaggttcagcatcccaatccagtggctgggctgatgaatttcaaacaccgtacattgctaatgcaaactcatgggcagatcagtttgcacatgaagagctttcacaaggggcggataagtgggttagcgakttctctagtcaacctaatcatggtgcactaaatgagaactgggttgatgagttctykaaatymaatgttactgacgaatgggcagaggaattcagtggaggtggttttggcgaaagctctgctgatccatgggtagatgagttccaagaacacttgtcatctttcaaacaaagtccgggcgcctctcgaggggtttatgttttttctgagaacaacccgtatgttggtcaccctaatccaatgcaggaaggacaggagctcttccgcaagggcctcttaagtgaagctgttcttgctttagaggctgaagttttgaagaatcctgataacgcagaaggttggaggttgttaggcgtaacacatgcagaaaatgatgatgaccaacaggccattgcagcaatgatgcgtgcgttggaagctaatccaacaaaccttgaagttcttcttgctcttggtgttagtcacacaaatgaattggagcagggggaagcattaaggtatctttataggtggcttcagaatcaaccaaaatatggtggccttgtccctctgcagtcaactgattcaccttatggtcctgatgttgttagattgtttaatgaagctgctcagatgtcacctgaagatgcagatgttcatatagttctgggagtcttatacaacctatcaagagagtatgataaagctatagcttcatttaagacagcactacagctcaaaccacaggactattcactctggaacaagcttggtgcaacccaagcaaacagcatccagagtgctgatgcaatattggcgtatcagcaggctctggacttgaaacccaactacgtgcgtgcatgggcgaatatgggaatcagctatgccaaccagggtttgtatgaggattccattcgatactatgtgagggcagttgcaatgaacccaaaagctgacaatgcctggcagtacctgaggatctctcttagcaatgcttcgcgagcggacatgattgctgcatgcgacgcccgcaaccttgacgctcttcagaaagagtttcctctgtgagccctctggtccaagacattagagcttccatggaaggaagcagcacactagcaagccgagagtgactgactgcacctgtggtcatggaaatggaattggaaaccagtagcgttttgtatttgcctgttgattcttatatttatttttaggaagtgggggaatgtgtagcaactaggaagcgagggaacaacatccagttgatgtgaagcattcatggcacagtaggcaatagtggcaaaggggtactatacatacacacttacgggacgcacaacataaataaagaatggttgattaataaactatttattttggggacacacccctaggatcaacccctacttgtttcgagtttgaatactgatttgtatcaacaggcaataaataatgcgctttgtaaccttttatatcataatgtaatgcgc

SEQ ID NO: 421 - DNA, 793 bp, Zea mays
cgacgcatccacccgaaccctcctccgcgacctcgccgtcgccgcagccttggccatgtcgatcttcgagtataatgggtccgccgtggtggcgatggtggggaagaactgtttcgcgatcgccagcgaccggcggctgggcgtgcagcttcagaccatcgcgacagacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagacctttgccagccttgtctctgcgctcctctacgagaagagattcgggccatatttctgccagccagtcattgctggacttggagatgacaacgtaccatttatttgtactatggactgcttaggtgcaaaggagctggccaaggattttgttgtatctgggacagcatcagaatctttgtatggtgcttgtgagtccatgtacaagccgaacatggaacctgatgaactcttcgaaactgtatcccaagctctgaattcatcaatagaccgtgactgccttagcgggtggggtggctatgttctgattgtgacaccgactgaagtgagggagcatgtgattaagagcaggatggactaaatcatggccactatcactataattcttagctggtttccaatgcttagaccaatgtcgtgtttggattctgaagtaacattgtatcatcacagctggtatgagaatgaacggttgttttattta

SEQ ID NO: 422 - DNA, 921 bp, Zea mays
ctccgatcctcgtcgccgacgcatccacccgaaccctcctccgcgacctcgccgtcgccgcagccttggccatgtcgatcttcgagtataatgggtccgccgtggtggcgatggtggggaagaactgtttcgcgatcgccagcgaccggcggctgggcgtgcagcttcagaccatcgcgacggacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagacctttgccagccttgtctctgcgctcctctacgagaagagattcgggccatatttttgccagccagtcattgctggacttggagatgacaacgtaccatttatttgtactatggactgcttaggtgcaaaggagctggccaaggattttgttgtatctgggacagcatcagaatctttgtatggtgcttgtgagtccatgtacaagccgaacatggaacctgatgaactcttcgaaactgtatcccaagctctgaattcatcaatagaccgtgactgccttagtgggtggggtggctatgttctgattgtgacaccgactgaagtgagggagcatgtgattaagagcaggatggactaaatcatggccactatcactataattcttagctggtttccaatgcttagaccaatgttgtgtttggattctgaagtaacattgtatcatcacagctggtatgagaatgaacggttgttttatttacccctatcttgcaagacttatgcctggattccagctgaattgtggaatactgaattgataatagcctagatctgttgttctcttacagaaacgtgaatgaggttaacatgta

SEQ ID NO: 423 - DNA, 1010 bp, Zea mays
cgcccccaccactctctcgatccaaagccagatcggcacgacgagcagaggccccccccggagcggcgcggagcaatggcggcgggataccgggcggaggacgactacgactacctcttcaaggttgtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgccggccaggaacgatatcgtgctattactagtgcgtattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatctccgccatcttgtagcagttcaaactgatgaaggaaaagcattcgcagagagggagtcattgtatttcatggagacctctgcactcgagtcgactaacgttgaaaatgcattcgcagaggtgttaactcagatctaccgtattgtgagcaagagagcagttgaagcaggcgaagatgcagcatctgggcctggcaagggcgagaagattaacataaaggatgatgtttcggcggtgaagaagggtggctgctgctctagctgagctgccctgctgtattttttggagttgtggtgatgtagcttatggtacggcatttccagcgaccgagaactggtagtggcattagcagcttctatgttacctagagagtttattgtcaaactggggaaaaaaaactgaaggttagatcggtgtagatctttctggtactgtattgtgtatccggcaataggcatggtattgtttttttttttgctgtgaatccactggtaccatgtttaaacttatgaattgttcaaaatagaaaggtgcttcatgcttgc

SEQ ID NO: 424 - DNA, 1141 bp, Zea mays
cgcgctcgctgccgtgccagtgtccccttcctttcccgtttccccctccctctctctttccccacgcccgacgcccccrccactctctcgatccaaagccagatcggcacgacgagcagaggccccccccggagcggcgcggagcaatggcggcgggataccgggcggaggacgactacgactacctcttcaaggttgtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgccggccaggaacgatatcgtgctattactagtgcrtattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatctccgccatcttgtagcagttcaaactgatgaaggaaaagcattcgcagagagggagtcattgtatttcatggagacctctgcactcgagtcgactaacgttgaaaatgcattcgcagaggtcttaactcagatctaccgtattgtgagcaagagagcagttgaagcaggcgaagatgcagcatctgggcctggcaagggcgagaagattaacataaaggatgatgtttcggcggtgaagaagggtggctgctgctctagctgagctgccctgctgtattttttgaagttgtggtgatgtagcttatggtacggcatttccagcgaccgagaactggtactggcattagcagcttctatgttacctagagagtttattgtcaaactggggaaaaaaactgaaggctagatcggtgtagatctttctggtactgtattgtgtatccggcaataggcatggtattgttttttttttgctgtgaatccactggtaccatgtttaaacttatgaattgttcaaaatagaaaggtgcttcatgcttgccaaattctgaattcgaagattcaatactaggtggagtggatatgaatatatgattttgtttg

SEQ ID NO: 425 - DNA, 664 bp, Zea mays
aaaagatcttcgtcttctctgcgtctcctttcagcagtctttgacatcgtcttgattcagccatggctaacgcggcgtcgggaatggcagtccatgatgactgcaagctaaggttcctggaactgaaggcgaagaggacgcaccgtttcattgtttacaagatcgaggagaagcagaagcaagtgattgttgagaaagttggtgagcctattcaaacctacgaggactttgctgcgagcctcccagctgaagagtgccgatacgccatttatgacttcgactttgtcactgcggagaattgccagaagagcaagattttcttcattgcgtggtgtcctgacgtagcaaaggtgagaagcaagatgatctatgcgagctccaaggacaggttcaagcgtgagcttgatggaattcaagtggagcttcaagcgactgatccaactgagatggatcttgatgttttcaaaagccgtgtcaattaaaaaacaaatattctctctctctctctctctctttgaataagcttctttggctcttacagtttcctgcgactgtataaaaacataacgccctttattctatccttatctggtctcgtcttctgcgtcgttgttaccgaacagtgttttcatcttatattgaaagttatcccaacgtttgtgct

SEQ ID NO: 426 - DNA, 637 bp, Zea mays
gaagaaaggaaaagaggagaaaaaaaacatccgtcttctctccgtcacctttcaccagcgttttgatccagcagccatggctaatgcggcttcggggatggcagtccatgatgactgcaagctcaggtttctcgaactcaaggccaaaaggactcaccgtttcattgtttacaagatcgaggagaagcagaagcaagtggttgttgagaaagtcggtgaacctattctatcctatgaggatttcgctgctagcctccctgctgaagaatgccgttacgccatttatgatttcgactttgtcactactgagaactgccagaagagcaagattttcttcattgcttggtgtccggatgtagcaaaggtgagaagcaagatgatctacgcgagctccaaggacaggtttaagcgtgagcttgatgggattcaagtggagcttcaggctactgatccaactgagatggatcttgatgttttcaaaagccgcgtcaactaaaaagaataagctttctttggctcgtattctatctactattcctgaatggtgttttcttttctctatacagtttcttcttgcaactgtgataaaaacctaactccccttcactctatttccatcccctctatcgtctctgtc

SEQ ID NO: 427 - DNA, 1038 bp, Medicago sativa
cggccggggatatttcaactcaacactacttcttttctttttctcttcacatctctctctttttgtttctcatagcaacaacaaagcagattcattcatcaaagaagaagaagaagaatggcgggttacagagcagatgacgactatgactacctattcaaggtagttctgatcggcgactccggtgttggtaaatcaaatcttctctctcgtttcaccaaaaacgagttcaatcttgaatccaaatccaccattggtgttgaattcgctactcgtactttaaatgttgattctaaagttattaaggctcagatctgggatactgctggtcaagaaaggtatcgcgccatcacaagtgcttactatcgtggggcagttggtgcacttcttgtatatgatgttacacgccatgcaacatttgaaaacgttgacagatggttgaaagaactgcgaaaccacacagattccaacattgttgtgatgcttgttgggaacaaagcagatcttcgtcaccttgtagccgtatcaactgaagatgggaagtcttatgctgagaaagaatcactttatttcatggaaacctcagctctggaggctactaacgtagagaatgcatttgctgaagttctgactcaaatctaccgtattgttagcaagaaagctgtagagggtgctgaaaatggaaacgcgtctgtgccggccaaaggagagaaaatagatcttaagaatgatgtttcagctttgaagagagttggttgctgctcaagctaagattggaaacataattcatttggttgctatcggctctgttgtatgtgtaatattccgaaagtgagagagatacaaattagaagaagacgaaaaaatgtaatttaatttttcatagtatgttagactctctatgtaatcttaaaagacaagtttcatgtttcaataggagctgctggggaagcaagtttattgctactagtctgtactctgtagtgttatagttgtttttgaaatgttctgcaattgattcagcttggaagtattaat

SEQ ID NO: 428 - DNA, 1157 bp, Medicago sativa
tataaattgaagatcagggttcatactttacagcatcattctcatgacgattttcaagcacaacggaagtgccgtagtagccatggttggcaagaattgcttcgccattgccagcgatcgaagactcggtgttcagcttcaaaccatagctaccgatttccaaagaatttccaaaattcatgataaactctacatcggtctttctggactcgccaccgattctcaaacactgtatcagcgtcttgtgtttcggcacaaactgtatcagcttcgtgaagaacttgatatgaaaccggagacttttgctagtttggtctctgctatgcaatacgagaaacggttcggtccatacttttgccagcctgtaattgctggattaggggatgatgacaaaccattcatttgcacaatggacgcgattggagcaaaagaacttgcaaaagactttgttgttgctggaactgcgtccgagtctctgtatggtgcttgtgaatcgatgtttaagcctgacatggaagctgaggaattgtttgagaccatctcccaagcactgttatcatctgtcgaccgtgactgtcttagtggctggggtggacatgtctatgttgtcactccaacagaagtaaaggaaaggattttgaagggaagaatggattaagttttaagccatctggtcaagtatttcatgttcactatggatagtgataaatatttggttgtttctagggtgagggctctagcaagtccctcaccaatggaccactttgaattacaattaggagccacttgattaattgagtgtacggatctaattatacattgtacacattagatcacacatctttttttaacttctcttctagctcatcaaaaaaaaaaaaacttaccctctctcccaaaccgccatacccatcgtcacagattccttccctcctccttttgtcacacatttatattttatgtgatcgtatgctgacgtttcctacttgggtttcattacattatgcctcttgatttctttatttaattgtatattcaaaatgatgcaaatgggttctttatatttatcgtgtcccatgtttttctttatatttatcgtggacaaattttgacccacgctgtgttattcatcaatgatatttttatgtatcaaagat

SEQ ID NO: 429 - DNA, 891 bp, Medicago sativa
gtactgacaggtggcactgggtttattctcccaattcacaattttaccttccatatccattttttcttctataaaaaattcaatttctctcacccaatcaaaaccatatattattatcaacattttatttttcattcttcctttcttgcacgaccatctgagtatagaacgatccctacatctcctcctccaccatcgcttgacagttattttccatatttgtcctttcaagcttcaagccgtagaacaaaaaacaatggcgaatgcagcatcaggtatggctgtgaatgatgaatgcaagttaaagtttttggagctcaaggcgaagaggacctatcggtatatcatttacaaaattgaggagaagcagaagcaagttgttgtggacaaggttggtgatcctgcaaatggttatgatgatttcactgctaatcttcctgctgatgagtgtcgatatgctgtttatgattttgattttgtcaccgaggagaattgccagaaaagcagaattttcttcatagcttggtgccctgatatttcaagggtaaggagcaagatgatttatgctagctccaaagataggttcaaaagggagcttgatgggatacaagttgagttgcaagctactgatcctactgagatggatcttgatgtgttcaaaagccgtgtcaattaatcttttgtgattgaataaaatttcttatgtggaatttgtctatagtttgtctgatggtcagcttggttaattacatacatatttgatttgccaagttttgacatgaagtctaatgcacctgaaacttctcttgtttccatattatggtttgtgacatactgggtttgtgttcgttttaatttttagtcccgtgcttactaatcgattaattttct

SEQ ID NO: 430 - DNA, 1042 bp, Medicago sativa
cggccggggatttttgtttgcaaacacaaatcacattgaaaaaattagggtttataatttacagtatcattctcttctccgtgttattgcgatctaacaaactatgtcgattttcgagtacaacggaagtgccctagtagccatggttggcaagaattgcttcgccattgccagcgatcgaagactcggtgttcagcttcaaaccatagctaccgattttcaaagaatttccaaaattcatgataaactcttcatcggtctttctggactcgccaccgattctcaaacactgtatcagcgtcttgtgtttcggcacaaactgtatcagcttcgtgaagaacgtgatatgaagccggagacttttgctagtttggtgtcttctatgcaatacgagaaacggttcggtccatacttttgccagcctgtaattgctgggttaggggatgatgacaagccattcatttgcacaatggatgcgattggagcaaaggaacttgcaaaagactttgttgttgctggaactgcgtccgagtctctgtatggtgcttgtgaatcaatgtttaagcctgacatggaagctgaggaattgttcgagaccatctcccaagcactgttatcatctgtagaccgtgactgtcttagtggctggggtggacatgtctatgttgtcactccaacagaagtaaaggaaaggattttgaagggaagaatggattaagttttaagccagctggtcaactactcaagttcactatgttttctgtttaattctgagctgaatggcgaacatgtaccgtctgttgttaatgggtacctttgttattgtgaacttaaattaaatgtacctagaaaattatttacaaacgagttcagctgttctatatagaattttcagtgaaagtagactctggaatcgggtatgctgtggaattaaattatgagtatatgtattggaatgtttttaggatagactggcattgcaagacacatattgttcaccgaaattgtttgtccctgaatccaattcatcgtttttccccgt

SEQ ID NO: 431 - DNA, 499 bp, Medicago sativa
aatcggcgactccgccgtaggaaaatcaaacctcttattccgattcgcgcgaaacgagttcgattcagggtcaagagcaacaattggagttgagtttcagacgcagatggttgaaatcgatggtaaagaagtgaaagcacagatctgggatactgctggacaagaaaggtttagagctgttacttctgcttattatcgtggtgcttttggtgctcttgttgtttatgatattagtaggagaggaacgtttgaaagtatcaagaggtggcttgatgaactcactactcaaaatgatagcaccgttgcgagaatgttggtgggaaataagtgtgatttggagaatatcagagaggtgagcatagaggaaggcaaagctcttgcagaagaagaaggtttgttctttatggagacatcagcactcgattctaccaatgttcaaacggcttttgagattgtcatccgggaaatttacaataatatcagccgcaaagtcttaaac

SEQ ID NO: 432 - DNA, 733 bp, Prunus persica
cctgctcatagctgattcctgatgataaatgcttcctgatcatgacaactttctgacgctaagatgtttctcgctcaaagaacatacccgcgcataaaagaagcctagagtccttcattgtctctgagagtcacakattttcagctcatttttcgttttggcctagattttctgcaaccgccatggctaatgcagcgtcgggatttgctgtggatgatgactgcaagctgaagtttctggaattgaaggctaaaagaacgtaccgcttcatagtattcaagattgaggaggagcaaaagcaggtgattgtggagaaacttggcgagccagctgaaagctatgaaaactttactgcaagccttcccgctgatgaatgcagatatgctgtctatgattttgactttgtgactgaggagaattgtcagaaaagcaggattttcttcattgcatggtctcctgatacatcaagggtgagaagcargatgatttatgcaagctccaaggacaggttcaagagagaactggatggtatacaagtagagctgcaggctactgatccgactgagattggtcttgatgttatcaaaagtcgtgccagctaagaagtctggcgtttatttatggcgatttttctcamcctctgttttacttttaagtgaaatgttaatagtttgtggtgctgtgaacctgactgaattataatacttggtttgttgttcaagttttaccttac

SEQ ID NO: 433 - DNA, 760 bp, Prunus persica
ctcgctgccctctccccaccgttaggcctatccatctctctctctctctctctctctctctctctgagccctagattttctcgccatttctctctacctcgacattttctcgggaaaatggcaaacgcagcgtctgggatggctgtgcatgatgaatgcaagctaaagtttttagaattgaaggcaaaacgaacttaccgcttcatagtgtacaagatagaggagaagcaaaagcaggttatagtggaaaaggtgggtgaaccagctgatagctacgaggatttctctgcaagcctccctgctgatgaatgccgatacgctgtctatgactttgattatgtgactgaggagaactgccagaagagccggattattttcattgcttggtcccctgacacatcgaaggtgagaagcaaaatgatctatgctagttcgaaggacaggtttaagagagagttggacggtattcaggtagagttgcaagctaccgatccaaccgaaatgggccttgatgttattagaagccgggcgacttgaatgttaagcatcagctcagcaactggagggggtcatctctatactatgtggtttttatgtgacctgtttatagtctatggacttgagtttggtttactattgtattgcattgcctttgagaatgtgatttgtaattcgtggattattggttacctcattctggtgtggatttcttgcccagcttgcatatataaatatatatttttctgtgcataaaaaaaaa

SEQ ID NO: 434 - DNA, 953 bp, Prunus persica
  misc_feature (811)..(811): n is a, c, g, or t
ttttattagtttcttgtgttgttgagcaaaagcattttgcacaaacaaaacaatctctcttcactttcagtctttcagtgaagagcaatttgatttttattttcagcaacatccccgatgtcgatcttcgagtacaatgggagtgcactgatcgcaatggtgggcaagaactgcttcgccatagccagcgatcggcgccttggtgttcagctccagaccgtcgccaccgacttcaagagaatcaaccaagtccacgataggctcttcatcggtctctctggcctcgccaccgatgctcagactctgtatcagaggcttatgtttcgccacaagctgtaccagcttagggaggagagggatatgaagcccgagacttttgccagcctcgtctccgctattctttatgagaaaaggtttggcccatacttctgtcagcctgtaattgctgggttaagtgatgaagacagaccattcatctgcaccatggattcaattggggccaaggaactagcaaaagattttgttgttgctggtactgcatcagagtccctttatggtgcttgtgaggcaatgttcaagcctgatatggaagcagaggagttgtttgagattgtctctcaagcattgctttcatcagtagatcgagactgtctgagtggttggggaggccacgtctttgttgttacaccaactgaagtgaaggagagaatcttgaagggaagaatggattgaccttgccacatggcttgtagtgatacctcctacctttcgttcaggcctgcatttttccctcgcgtttatgtagctttgnacttgatgggcagccataagttttattgggtgatcagggccccttggtatgtggtgattagattttatgtactttgacgattatagacaatggggtcatttgatttatattaggtcacttttgggaaaatgttgggattcca

SEQ ID NO: 435 - DNA, 1020 bp, Prunus persica
ccagagagccaccgaatataaaggggcttaacatttcttctgcgagacacagctagtcgtcatcggaggagagacccttccctatatcttctcctcctgcttcgtcgccaacaaaacccgaacaaagagaaaagatggccaacgcagcatctggtatggctgtgcatgatgattgcaaattgaagtttttggagcttaaggccaagaggacctaccgctcaattgttttcaagattgaggagaagcaaaagcaagttgtggtggaatctgttggtgaaccaacagagacctatgagcagttcgcaggaaaacttcccgctgatgaatgccgttatgctgtttttgattttgatttccttacaccagaaggtgtacagaagagccgcatattcttcattgcatggtctcctgatacatcgagggtgagaagcaagatgatctatgcaagctcgaaagacagatttaagagagagcttgatggaatccagattgagttgcaagcgactgatccgactgagattggtcttgatgtcattaaaagccgtgccagctagataatcataggctatttggttgggagtgttcttcccttcagccttttgttacttgcgtggaatgtttatacattgtgggatggcaacttggctaatgatggcatgaatttccaagtttcgccattgtttcttattcgttttgaacaagtgtctgtggtttccggtatatcatatgatatgtttatttgatagaacctatttgttgagtggctgccttagtagccgcatgtcaacaaactaatatgtagctgtttgtggtgggtttagacgacaccttactcttttcaagtgttgtatatgacccttgtcattttactttggagcagtataaaggagcttgctttatgaccttccttgttgctgatttcttggcttgttttgtattcaccgatatggatttttgatctatctaatgggctgtttctcatgaagtggttcaatgaaccatttgagtgtggttttacgc

SEQ ID NO: 436 - DNA, 813 bp, Arachis hypogaea
gaactctcttctcttctcttctctttttccacttccctttatatatcgaaccactcacaaatacaaacctttcctatatctctcctcagtcctctctcatcgcactcgtcgatatcaaaatatggcaaatgcagcatcaggtatggcagtccatgatgactgcaagctaaagttcttagaactcaaggccaagaggacttataggtttatcgttttcaagattgaggagaagcagaagcaagttgttgtcgagaagcttggtgagccagcacaaggatatgatgatttcactgccagtctccctgctgatgagtgccgatatgctgtctatgattttgattttgtcactgaagagctttgccagaaaagcaggattttcttcattgcttggtccccagatacagctagggttaggagcaagatgatttatgctagctccaaagagagattcaagagggaacttgatggaattcaagtagagttgcaggcaactgatcctactgagatgggtcttgatgtcttcagaagccgcaccaattaaactattgtaaactattgtgattaggaatagaaggagttatcatgaaagactctttatggagatgtatgtctatatacacaatttgtggaatggtcaacttgggtaattatggactccattgttccaggttttgacatgtagtctattacaccttcaaaacaagcttcttttgttccagtgtatcttgtggtttgtgattcttacagaatctgatctgtatccgagtggcattgatttaatatgggcacttgtcatttgatatttttactgag

SEQ ID NO: 437 - DNA, 846 bp, Arachis hypogaea
  misc_feature (782)..(782): n is a, c, g, or t
gggcatcggttacgatgcgggactttcatcgttacttgtatcccaaagaaaagcactttttaaaacataaacaaactcgcgagctgcaacatctcagtgtctcccttctcttcgttattcttgggttgctcaaagttaaaatgtcgatcttcgagtacaacgggagtgccctagtggctatggttggcaagaactgctttgccatcgccagcgatcggaggctcggtgtccagcttcaaaccatagccaccgatttccaaagratctcmaagatacacgacaaactcttcatcggtctctctggcctcgccaccgatgcccaaactctgtaccagcgtctggttttcaggcacaaactgtatcagcttagggaagagagggatatgaagcccgagacctttgctagcttggtctctgcccttctttatgagaaaaggtttggtccatacttttgccagcctgtaattgctggcttaggagatgaggataaaccattcatttgcacaatggattcaattggagcaaaggagcttgctaaggattttgttgttgctggcactgcctctgaatctctatatggtgcttgcgagtcaatgtttaagcctgacatggaaccagaagaattgtttgagactatctctcaagctctgctgtcatcagtagatcgtgattgtttaagtggctggggtggacatgtctatgttgttacaccaactgaagtaaaggaaaggatcttgaagggaagaatggattaaccagttacactcctcagatcacatgtncatttagtttggacctgaatagtagtctccatttaccatccacactgggtttatggaatgccat

SEQ ID NO: 438 - DNA, 661 bp, Capsicum annuum
gttgtgttgttcaagacaccaaaaacacactctttctcttcattggcaaagcaaaaaaattcaattcgtttctctccgatgtcgatctttgagtataatgggagtgctttggtagcgatggttgggaagaactgttttgctattgctagtgataggagacttggagtacagctacagacaattgctactgattttcagaggatttataagatacatgataagcttttcattggactttctggcttggctactgatacacaaacgctgcatcaacgtcttgtcttccgccataagctatatgagcttagagaggagaggaatatgaagcctgagacctttgccagccttgtatctgctatgctttatgagaagaggtttggcccatacttgtgccaacctgtaattgctggattaggtgatgatgacaagccttttatttgcaccatggactctattggagcaaaggagctcgcaaaagattttgttgtttctggcactgcatctgaatcactttatggtgcttgtgaggccatgttcaagcctgacatgggaccggaagaattgtttgagaccatctcccaggcgctgatatcatctgtagaccgtgactgtttaagtggttggggaggacatgtttatgttgtgacaccaactgaagtga

SEQ ID NO: 439 - DNA, 756 bp, Capsicum annuum
aaacaccccaaccttcttcttgaaccttgaaccttgaaccttcttcttcaatccctttgaatttttcaattcaatcaaaatggctaacgcagcgtctgggatggctgtgcatgatgactgcaagttaaggttcttggagctgaaagcgaaaagaactcaccgctttgttgtttttaagatagaggagaaacaaaagcaggttgttgttgaaaagattggtgagccaactcaaagttacgaagatttcgctgcgtgtcttcctgagaatgaatgtcgatatgctgtctacgattttgatttcgtcactgcagagaattgccagaaaagcaggatttttttcattgcatggtcccctgacaccgcaagggtgagaagcaagatgatctatgccagttcaaaggacagattcaagagagagctcgacggaattcaggttgagttgcaagcaaccgacccgactgaaatgggacttgatgttattaagagccgcgccaactagatatcgactcatagttatcagatgggcccttataaatgagagctcctaatgcaatcataaggaaatatttaaaagtgtgacagatacttggtatattggttgccaagtgctacagtatatgtacttttcaatgaaaagttttatggtgtttggtatatgatgtaatttgttacttccaaatttcactggtagcttgattctataaactactattatgtatccatttttgagggataggtacattttagatccttttt

SEQ ID NO: 440 - DNA, 707 bp, Petunia x hybrida
ccgcgttcttcttgagctttgagccctttctctcctatttttggttctatccactacaaactcaaaatggctaatgcagcgtctgggatggctgtgcatgatgactgcaaattaaggttcttggagctgaaagcaaaaagaactcaccgctttattgtttataaaatagaggagaaacaaaagcaggtggtggttgaaaagattggcgagccaaccgaaagctatgaggatttcgctgcaagtcttcctgagaatgaatgtcgatatgctgtctatgattttgatttcgttactgcggagaattgccagaagagcaggatatttttcattgcatggtgccctgacacagcaagggtcagaagcaagatgatctatgccagttcaaaggacaggttcaaaagagagctagacggaattcaggttgagttgcaagcatgtgacccaactgaaatgggactcgatgttattcagagtcgtgccaactagatatcaatggatagagatatcagctggaccttataagttccaatgaaatcatctttacttgaggaaatttatagtgtgacagatacttggccagggttgatactggttgccaagtgctacagtttatgtactatctaatggataagttcgttttatggtgtttggtatatgatgtaacttgttacttcaaattctaagtgtttcactggttgattctacca

SEQ ID NO: 441 - DNA, 856 bp, Petunia x hybrida
gacccctcwtcwtcgttawsawmakwamwwcaccaactttatcggacccctacattttctcttccaacccacctctctctctttctcctggaatcatggctaacgcagcatctgggatggctgtgcatgatgattgcaagctgaagtttttagagttgaaggccaaaagaacttaccgcttcataatctataagattgaagagaagcaaaagcaggttgttgtggaaaaacttggtgaaccaactgaaagctatgaggatttcactgcaggcctccctgctgatgagtgtcgttatgctgtctatgactttgatttcatgacaaaagaaaaccaccagaagagcagaattttcttcattgcttggtctcctgacacggcaagggtgagaagcaagatgatttatgcaagctccaaagacaggttcaagagagagcttgatggaatccaagttgaattgcaagcaactgatcctacagagatggggcttgatgtcttcagaagccgagctggtggaattgaatgttgagtgcgtcaatgtcttgcttatgttaagtgattacaggtttgtgggaaagtagaacttggttagttatactaatggcttgtcgttcctcgttcttcgaactcttctaagtttcttcttctcagagaacttcaatactctttaatatatgttatatggttactcatgatatcaaggaacaccttgtcattttgggcattagtattttcttttaatgttggtgagcattaggctttatcacttggtgaaactcgagtgcccagattcttgtaatgttgtgttctatttgtgtaaaggtaaaataatgttcttgtatctaaatctattcttat

SEQ ID NO: 442 - DNA, 565 bp, Petunia x hybrida
ctcaaggtggtgttgatcggggattcaggtgtgggtaaatcaaaccttctttcaagattcactcgtaatgagttcagtctggagtctaagtcaaccatcggtgtcgaatttgccacacgtagtattcgtgtcgacgataaagtcgtcaaagctcagatttgggatactgctggccaagaacgatatcgtgcaatcacaagtgcctactatcgaggagctgttggtgcattgcttgtctatgatgtaactcgtcatgtaacttttgagaatgtggagagatggttgaaagagctccgagatcacactgactctagcatcgtcataatgctggtgggtaataaggcagatttgcgtcatctgcgcgctgtttctactgaggatgccaaggcatttgctgagaaagaaagcacgttcttcatggaaacgtctgctttagagtccatgaatgtggacaatgccttcacagaagtgctcactcaaatacaccgtgttgttagcagaaaagctcttgaagtaggagatgatccggctgcattgcccaagggtcagactattaatgttggag

SEQ ID NO: 443 - DNA, 907 bp, Ananas comosus
acgccgaaagctattataccccttcttttacacgtctcatcactttgcgctccgctctccttccccacaccgcccctcccccatcatcgcgttcacattctctctctctctctctctctctctctctctctcctcgagtttctctctcatcctcgtcgactcgtcgtctccctttcatcttcgatcgatcgccaccgcggagagaaatggccaatgcggcgtcgggaatggctgtgaacgatgagtgtaagctgaaattcttggagctgaaggcgaagaggactcaccgcttcgtaatcttcaagatcgaggagaagctgaagcagatcatcgtggagaaggtcggtgagccgactctgaactatgatgatttcaccgcgagcctcccagcggacgagtgcagatacgccgtctatgactttgatttcgtcacggaagagaattgccagaagagcaagatattcttcattgcttggtcgccggacacttcgagggtgaggagtaagatgctctatgctagctcaaaggacaggttcaagagggagttggatggtattcaggttgaactccaggcaactgatcctactgagatgggattggatgtcatcagaggccgcgccaactgaagctgcatttattcataatgcaatgggttagttggctacttacctgtggtgttcataatttcacgggacaatgtgttggctagataatatggctatttctttttcagtttattacatactatactgttttgcccttgaataacatcattaattctggctatgccatttgttattctcccggacctatctgatgggtgtttccttgtagaaggatgtttacaagctaatgattgcagcggtttgcggtggtagccggacaggcaaaacccttgtttcctttt

SEQ ID NO: 444 - DNA, 899 bp, Ananas comosus
accgcaacccagcaaatccaccgcctcgatcgtctcctcctttttctcctcctcctcctcctctttcgttctcgatctaaattccccgaatcctccgatctcggatccgattcctcacaccttcgagtcctagatcccctcccccgatctcctcgctgcgatcgccgcttccgaaatggccaacgcagcgtcaggaatggctgttgatgatgattgcaagctgaaattcctcgaattgaaggcgaagaggactcaccgcttcataattttcaagattgatgagaagctgaagcaggttgtagtggaaaagcttggcgagccatcttcaagctatgaggatttcactgctaacctccctgccaacgaatgcagatatgcaatttatgactttgattttgtcactgaagagaatgtccagaaaagcaggatcttcttcattgcatggtctcctgacatttcgagagtgagaagcaagatgctttatgccagctcaaaggacaggttcaagagagagctagatggtatccaggtggagctgcaagctactgatccttctgagatggacctcgatgtcatcagaggccgtgccaattgaataccagcagcggaggtattctccctgcactttggtttggtttggtgaatgtttatagtatgtgggagggttgatttggtcgatataatatggcttgttgtctatgttataaataccttattgcttctgatgaatctttatgccatttggaggtcatgcaagttgagcattcgcagtggagatgttttccctgtgctttgctagatttgattaatgttcacacttcatggaatgatggatttggtagactatatggcttgtgtaggctattaagtacttcttgccctattggaattgtttctcg

SEQ ID NO: 445 - DNA, 1048 bp, Ananas comosus
ctctctaaaagcggaagaggaaagtgaggtagagagagagagaaagagctaaacataaaacaccgcgcccacactcagagacaccgccatttctccgtctctgcacgcctcctccgatccgaatcgaagagaacgaagaagacgaagacgaagaggggatagagagaggtagagagaaggaggcgtccatggcggggtatagagcggaggacgactacgactacctcttcaaggtggtgctcatcggcgactccggggtggggaaatcgaacctcctctcgcgattcaccaggaacgagtttagcctcgagtccaaatccaccatcggggtcgagttcgccacaaggagcttgagcgtcgatgggaaggtcatcaaggctcagatttgggacaccgcgggccaagagaggtatcgcgccatcactagtgcatactaccgaggagctgttggtgcgttactcgtctatgatgtcacccgacactctacatttgagaacgctgaacgctggctgagagaattgagagaccacacagatccaaatatagtcgtcatgctggtcggaaacaagtcagatctccgtcatttagtagctgtttctgccgaagaaggaaaggcctttgcagagagggaatctctctatttcatggagacatctgcattggaatcaaccaatgtggaaaatgcctttgccgaggttttaactcagatttatcatattgtcagtaaaaaggcggttgaaacaggggacgatggagcttctgcggtgccgagtaaaggggagaaaatcaatgtgaaggacgatgtttctgcgctgaagagagtggggtgctgctctacttgattaagctactttcccgcttttccgtggtttgtgttttactgtagactgtagtgtttgtttccagactactctttgtggcattaagatttgtttaggttatgcgcaccattacattttgttaaaccaggaaagctttgtcaggttcagtgtactttttatttgttgcgttacaaatccttgatgaattaaagcatataccttgcatt

SEQ ID NO: 446 - DNA, 756 bp, Ananas comosus
caccgacgtattatcaatcttctttttcgatcgatctcgatttgcgcttcgctcctcgtttaaagcctctgatctcggagccctaatctcgccggagccctagattttctctctctctctctctctctctctctctctctcgccgctctccctttcccaaaatggccaatgctgcatctggaatggctgtgaatgatgattgcaagctgaaattcttggacctgaaggcgaagcgaacctaccgcttcataatttataagattgaggagaagctgaagcaggtcgtggtggagaagctcggcgagccgactctgggctacgaggatttcaccgccagccttcctgcaaatgaatgcagatacgcggtttatgactttgatttcgtgactgaagagaactgccagaagagcaagatcttcttcattgcatggtcccctgacacgtcgagagtgagaagtaagatgctttatgcaagctcaaaggacaggttcaagagggagttggacggtatccaggtggagttgcaagcaactgatcctactgagatgggccttgatgtcattagaggccgtgccaactgagtatcttttgcttctgcagtggaggtattctccctgcactctagttgcttcagtgaatgcttatatytcctgggatggtggatttggtagacataatacgggctttgtcgtcgagtatgttaaatacttcttgcccgctttgactcgtctttacctttggtatatatatatcttg

SEQ ID NO: 447 - DNA, 1501 bp, Pinus pinea
aggctttgtatgcaaaagccttgcgaatcacgatattattttccagcttacattacaatattataatattatcataaatggtaaagtaataccctttctggtcacagcgaaagcatttcacaggccagagagttccgaaccagggttttatttaccttctaaatagtgcaacgcaacaagactaaccgatggcatcttgcagcagaaatttgcagtaacaggcgcagaaggacaagaataacttcattaatatacaaagaaacctagctgcagcttggggaggcagactcagttctctacaccccctaacatctcagcaatgtcgatatttgaatataatggaagtgctttggtggctatggttgggaaaaactgctttgccattgccagtgatcgccgtttaggtgtgcaactgcaaacaatagctactgattttcagcgcattttcaagattcatgataagctatacgtgggtctttctggattggccacagatgtgcagactttgtaccaaagatttgcttttcgccataagctttatcagctgcgcgaggaaagaaatatgaggccagaaacttttgcaagtcttgtttctgcgttactttatgaaaagaggtttggtccttacttttgtcaaccagtgattgctggattaggggaagatgataaaccatttatctgcaccatggattcgattggtgccaaggaactggcaaaggactttgttgtagctggtactgctgcagagtcactttatggtgcatgcgaatctatgtacaagccagacatggaaccagaagagctatttgagacaatttcccaggctttattgtcatccattgatcgtgattgtttgagtggctggggaggccatgtttatgtcgtgtcaccaaatcaagtgactgagcgcacattgaaggggcgcatggactgagccttttttcttgcaagagaaattgcaggtcttagcaatgttattggtggctattaaatgaacaaaattgtgctttcgtacatagtggagttagagttgttgaaatcattaatacatttgatgtcattgcacaagaagacatcttccatcacatgcctctcttttcttgcatctctaatcaatttgcaatcaagtctttctatggaccaagtttacaaatactcaaatttcacttatcctaattttaaattgatacattttgagggagcaacattttctgaaattttgtactcttatgtgagagacagatttctttgcttgttataaattggtgatcctttttcatgtattgacattcagaaagtagctacccagtcaataatgctagtgctgggtgaaatattactcgtcaaatatttcacatttgcaaatgagaaccttcagtgctgtaacatctgtgaaggaagtatttgaaaaatgcggttattttttgtcatctgcagcctgctgcatattatgttacattttgctttgaggtttatcacatattagagtttggcatgtttt

SEQ ID NO: 448 - DNA, 1593 bp, Pinus pinea
cggccgggggcttcacattgaagtactctgaattgaatatgagcatagcttgcttgtcgatgttgtaaacggtttcgtatttgaaagtctcgcgatattattttccagcgtacattataatatgatcataaatgataaagaagttccctttttcaaagaaagtgaaagcggtcggagcgaaagcattttatacgggcaacagatgtacgaaccagggttttattcaccttctaaatagtgcaacacaacaaggtcgtagaaaaaagttgcagtaacaggcgtggggaaaggacaaggtcgtctccccattcctaaatttacacatgcccagctgagttcttgattgcagtttgctttctcaagaataacttcattaatatacaaagaaacctagctgcagcttgtggagacacgcccaattctctacaccctctacatctgtataagcaatgtcgatatttgaatataatggaagtgctttggtggctatggttgggaaaaactgctttgccattgccagtgatcgccgtttaggtgtgcaactgcaaacaatagctactgattttcaacgcattttcaagattcatgataagctatatgtgggtctttctggattggccacagatgtgcagactttgtaccaaagatttgcttttcgccacaagctttatcagctgcgtgaggaaagaaatatgaggccagaaacttttgcaagtcttgtttctgcgttactttatgaaaagaggtttggtccttacttctgtcaaccagtgattgctggattaggggaagatgataaaccatttatctgcaccatggattcgattggtgccaaggaactggcaaaggactttgttgtggctggtactgctgcagagtcactttatggtgcatgcgagtctatgtataagccggacatggaaccggaagagctatttgagacgatttcccaggctttattgtcatcaattgatcgtgattgtttgagtggctggggaggccatgtttatgtcgtgtcaccaaatcaagtgattgagcgcacattgaagggacgcatggactgagctgtttttttgcaagagaaattacaggtcttagcaatgttattggtggctattaaatgaacagaaatgtactttagtacatagtggagtcagagttgttgaaaacattaatacatttgatgtcattgcacaagaagccacctaggctttcattacttgcttctcagttcaatcctccagaggccaatgcaaactgaaccttttcctgcatctctaatcaatttgcaatcaagtttttctatggaccaagcacacaatcaaatttcacttatcctaattttaaagtggtacattttgagggagcaacattttctgaaattttgtactcttatgtgagatactgatttctttgcttgttataaastggtgttacttttccatgtattggcattcagaaagtagctacccagtcaataaaattaatgctcggtgaaatattattcgtcaactatttcacatctgcaaatgagaaccttcggtgctgtaacattagtgaaggaagtattgaaaaatgcggttattttttgtc

SEQ ID NO: 449 - DNA, 1047 bp, Populus tremula x Populus alba
aaagaaaaagaaaccagcaagagggagagagacataggggagaacctccattatctctcaaaaagtaaaagcctgtgttgaatcgaagaaagcaaaaccctaaaaactgtgtctctgtctctgtgaatctggtgttttccttgccttgttatttttgcctccgatccctataagaaggaaaatcatggccaacgcagcatctggtatggcagtgcatgatgactgcaagctgaaatttttggagctgaaggctaaaagaacttaccgcttcatagtttataagattgaggaaaagcaaaagcaggttattgtggaaaagcttggtgagcctgcccaaagctatgaagattttaccgcaagcctccctgctgatgagtgtcgctttgctgtttatgattttgattttgtgactgcagagaatgtccagaagagcagaattttcttcattgcatggtctcccgacacatcaagggtgagaagcaagatgatttatgctagttctaaggacaggttcaagagagaactagatggtattcaggtagagttgcaggcaaccgatccaactgaaatgggtctcgatgtcattagaagccgtgccagctaaatacaagtctcccaatttcgcggtggagtttgatgcactctacatctgagcgaaatgcttatggcttgtggcaatgaacccgactgaattatgagattggtttgtttgtttgagttttacccttcagtcctcttctagaaccgatctggtgattctggttctatttctatgatccgtcatgtaatgaacttatgggatgtgtgtttccttatagctatgtttgcaatctatggtgtatcatcatatgatggtagagaaaccaggatttgtttctacaactctgcaaatggatgtttgactctttcttagatttgttcttacaaccctgttctatttccagtcttggcattgtcattgaagtgttggtgtggatagttcattttatacatggacgtgctaacgaaaagctagtctgcctttcttctataataatttcttttccc

SEQ ID NO: 450 - DNA, 858 bp, Populus tremula x Populus alba
gcagaccccaactccgtcccctctctttctctctccctctataaatatctctctatattaccgggtccgatatttatccaactcattcgtagaccacctccattcctcctataaccatggccaatgcagcatctggtatggcagtgcatgatgactgcaagctgaagtttttggagctcaaggctaaaagaacttaccgcttcatagtttacaagatcgaggaagagcaaaagcaggttattgtggaaaagcttggcgagcctgcccaaagctatgaagattttactgcaagcctccctgctgatgagtgtcgctatgctgtttatgattttgattttgtgactgaagagaatgtccaaaagagcagaatcttcttcattgcatggtgtcccgacacatcaagggtgagaagcaagatgatttatgctagttctaaggacaggttcaagagagaactagatggtattcaggtagagttgcaggcaactgatccaactgaaatgggtctcgatgtcattagaagccgtgccagctaaatacaagtctcccattttcccggtggagggttctatgcactctacgtataagcgggatgttcatagcttgtggcggtgagcctgactggattatgatactggtttgtttgtttgagttttatcttatagtcctcttctggaaccaaaccaatttttttttattatgcttttatgatcgatcttgtaatgaacctctgcgatgtgtttctttatagctgtgcttacaatctctggtgtatcatcatctgatggtagataaaacctggatttgttttatacatttcgaaaatggatgctttgacactttctcatgtttgcatca

SEQ ID NO: 451 - DNA, 979 bp, Populus tremula x Populus alba
gcagaccccaactccgtcccctctctttctctctccctctataaatatctctctatattaccgggtccgatatttatccaactcattcgtagaccacctccattcctcctataaccatggccaatgcagcatctggtatggcagtgcatgatgactgcaagctgaagtttttggagctcaaggctaaaagaacttaccgcttcatagtttacaagatcgaggaagagcaaaagcaggttattgtggaaaagcttggcgagcctgcccaaagctatgaagattttactgcaagcctccctgctgatgagtgtcgctatgctgtttatgattttgattttgtgactgaagagaatgtccaaaagagcagaatcttcttcattgcatggtctcccgacacatcaagggtgagaagcaagatgatttatgctagttctaaggacaggttcaagagagaactagatggtattcaggtagagttgcaggcaaccgatccaactgaaatgggtctcgatgtcattagaagccgtgccagctaaatacaagtctcccaatttcgcggtggagtttgatgcactctacatctgagcgaaatgcttatggcttgtggcaatgaacccgactgaattatgagattggtttgtttgtttgagttttacccttcagtcctcttctagaaccgatctggtgattctggttctatttctatgatccgtcatgtaatgaacttatgggatgtgtgtttccttatagctatgtttgcaatctatggtgtatcatcatatgatggtagagaaaccaggatttgtttctacaactctgcaaatggatgtttgactctttcttagatttgttcttacaaccctgttctatttccagtcttggcattgtcattgaagtgttggtgtggatagttcattttatacatggacgtgctaacgaaaagctagtctgcctttcttctataataatttcttttccc

SEQ ID NO: 452 - DNA, 1125 bp, Populus tremula x Populus alba
aaattatttatgtcttgagaatacaagaactaaattataatttacccaacttaaaattctgattccatcaaccgagagagaaaagagagtagagagagagagagacgcaaaacatagagaagcagcagtcctccattttctctcaaaaagtaaaagcctgcgttgaatagaagaaagcaagacccaacaatctctctgtctctataaaatcttgttctacccttgtcttgcctttgttattcttgcctcgaccgatccctataagaagaagcacaatcatggccaacgcagcatctggtatggctgtgcatgatgactgcaagctgaagttcttggagctgaaggcgaaaagaacttaccgcttcatagtttataagattgaggaaaagcaaaagcaggttattgtggaaaagcttggcgagcctgcccaaagctatgaagattttactgcaagcctccctgctgatgagtgtcgctatgctgtttatgattttgattttgtgactgaagagaatgtccagaagagcagaattttcttcattgcatggtctcctgacacatcacgggtgagaagcaagatgatttatgctagttccaaggacaggttcaagagagaactagatggcattcaggtagaattgcaggcaactgatccaactgaaatgggtcttgatgtcatcaagagccgtgccagctaaatgcatgtctccaaatttcgcagtggagagtttgatgccctctacatttgagcgaaatgtttatagcttgtggcagtgaacctgactgaattatgagattggtttgtttgcttgagttttaccctacaatcctcttctagaaccaatccggtgattttggttctatatttatgatccgtcatgtaatgaactaaagggatgtgtgtttccttatagctatgttcacaatcttcggtgtaccgtcatctgatggtagagaaaccggggtttgttcctacaactttgcaaatggatgtttcactctttttcagattttttttcacgactgtttaattcagtcctgggatttgtcattgaagtgttggtattgatggttcattttatacatggatgtggtactaaccaaaaagagtctgcttttcttcta

SEQ ID NO: 453 - DNA, 1018 bp, Populus tremula x Populus alba
caccagagaggagagacacacacacagaattctccctctctcaaaaagttggcatttgaagaaagcaaaccccaactcctctaccactccccctccctctataaatctctctctattttttgtgcgatatttatctaactgattcattcatatacctcctaatctacaaccatggccaacgcagcatctggtatggctgtgcatgatgactgcaagctgaagttcttggagctgaaggcgaaaagaacttaccgcttcatagtttataagattgaggaaaagcaaaagcaggttattgtggaaaagcttggcgagcctgcccaaagctatgaagattttactgcaagcctccctgctgatgagtgtcgctatgctgtttatgattttgattttgtgactgaagagaatgtccagaagagcagaattttcttcattgcatggtctcctgacacatcacgggtgagaagcaagatgatttatgctagttccaaggacaggttcaagagagaactagatggcattcaggtagaattgcaggcaactgatccaactgaaatgggtcttgatgtcatcaagagccgtgccagctaaatgcatgtctccaaatttcgcagtggagagtttgatgccctctacatttgagcgaaatgtttatagcttgtggcagtgaacctgactgaattatgagattggtttgtttgcttgagttttaccctacaatcctcttctagaaccaatccggtgattttggttctatatttatgatccgtcatgtaatgaactaaagggatgtgtgtttccttatagctatgttcacaatcttcggtgtaccgtcatctgatggtagagaaaccggggtttgttcctacaactttgcaaatggatgtttcactctttttcagattttttttcacgactgtttaattcagtcctgggatttgtcattgaagtgttggtattgatggttcattttatacatggatgtggtactaaccaaaaagagtctgcttttcttcta

SEQ ID NO: 454 - DNA, 756 bp, Populus tremula x Populus alba
caccagagaggagagacacacacacagaattctccctctctcaaaaagttggcatttgaagaaagcaaaccccaactcctctaccactccccctccctctataaatctctctctattttttgtgcgatatttatctaactgattcattcatatacctcctaatctacaaccatggccaacgcagcatctggtatggctgtgcatgatgactgcaagctgaagttcttggagctgaaggctaaaagaacttaccgatccatagtttttaagattgaagaaaagctaaagcaggttattgtggagaagctgggtgagccagctcaaagctatgaagattttactgcaagcatccctgctgatgagtgtcgatatgctgtttatgattttgatttcatgactgcagagaatgttcaaaagagcaggattttcttcattgcatggtcccctgacacatcaagggtgagaagcaagatgatttatgccagctctaaggacaggtttaagagagaattggatggtattcagatagagttgcaggcaactgatccaactgaaatgggtcttgatgtcattagaagccgtgccagttaagtgtttatagcctgtggcgttgaacctgactgaattatgaaatcggtttgtttgtttgagttttatccgatagccctcttctggaatcaatccagtgattttgattgtatttttttatgatccatcatgtaatgaacctatgcgatgtgtgtttccttatagcca

SEQ ID NO: 455 - DNA, 940 bp, Populus tremula x Populus alba
caccagagaggagagacacacacacagaattctccctctctcaaaaagttggcatttgaagaaagcaaaccccaactcctctaccactccccctccctctataaatctctctctattttttgtgcgatatttatctaactgattcattcatatacctcctaatctacaaccatggccaacgcagcatctggtatggctgtgcatgatgactgcaagctgaagttcttggagctgaaggctaaaagaacttaccgatccatagtttttaagattgaagaaaagctaaagcaggttattgtggagaagctgggtgagccagctcaaagctatgaagattttactgcaagcatccctgctgatgagtgtcgatatgctgtttatgattttgatttcatgactgcagagaatgttcaaaagagcaggattttcttcattgcatggtcccctgacacatcaagggtgagaagcaagatgatttatgccagctctaaggacaggtttaagagagaattggatggtattcagatagagttgcaggcaactgatccaactgaaatgggtcttgatgtcattagaagccgtgccagttaagtgtttatagcctgtggcgttgaacctgactgaattatgaaatcggtttgtttgtttgagttttatccgatagccctcttctggaatcaatccagtgattttgattgtatttttttatgatccatcatgtaatgaacctatgcgatgtgtgtttccttatagccatacttacagtctctgttgtaccagtacttgttttttacatttctgaaaatggatgttccgacaatttctcatatttgcattagaagacttgttctaaacattaataaaatatagcgataaaaaacttaaagagttactggattagtgagatttataaacgagtttaagattgtgattcaactgc

SEQ ID NO: 456 - DNA, 984 bp, Populus tremula x Populus alba
aaacagctaaagaaatcctcaagggcctcttccattctcttctcctgctatttactctctctctctctttctttttcgctcttcattttccgatgtcgatcttcgagtacaatggaagtgccatagttgctatggtgggaaagaactgcttcgctatagctagcgatcgccgacttggagtcaaccttcaaacagtcgccactgatttccagcgaatctacaaaatccacgataaggtcttcgtcggtctctctggccttggcactgacgcccaaacactgtaccagaggcttgttttccgtcacaaactgtaccagctgcgagaagaaagggacatgaagcctgagacttttgccagccttgtttctgctatactatatgagaaaaggtttggtccgtatttctgccagcctgtcattgctggattgggtgatgatgacaagccattcatctgcacaatggatttcattggggccaaggaacttgcaaaagattttgttgttgccggctcagcctctgagtcactttatggtgcctgtgaagcattgttcaagcctgacatggaacctgaggaattatttgaagttgtatcccaagcattactagcatcagtagatcgggactgcttgagtggttggggaggacacatctatattgtcacccctgatgaaattagagagaaaatcctaaagggaaggatggattgatggaagccctcctacatgtccatgatgccaccagtttttctatcttcccaaaccatagacttggagttttaatggaacattctgttttctttgttaatggaagatgttatcttgcaggaatggttaaaaaatgtaatttggataaaatttcgaagtgcgttagcgaagtttcaccttattgtctagttatggcgtgtattggatgtggcttttactttgaaaattgataccctaatcattgcttggcaaaatggtgcacgcagctatctccattccc

SEQ ID NO: 457 - DNA, 1059 bp, Populus tremula x Populus alba
cagcagtctcccccatttccaactcacaacaataccaaaagattcatagaaaagcaaaagaaaacaccaccatttctctccctctctccctctctctctccgtagcttcctttctttgaagcaaagcaagaagagtaaaggtagcgtgtgacaactagtaatggctggatacagagctgaagatgactatgattacctgtttaaggtagttcttattggtgactcaggtgtgggcaagtccaatctgctttcaagattcactcgtaatgaattcagtttggagtctaagtctactattggtgttgagttcgctactcgcagcttgaatgttgatggcaaggtcattaaggcccagatttgggacactgctggccaagaaaggtaccgtgccataactagtgcttactaccggggagcggtgggtgcacttcttgtgtatgatgttacccggcactcaacatttgaaaatgttgaaaggtggctaagggagttgagggatcatacagatcctaacattgtcgtgatgctcattggcaataaatcagatcttcgccaccttgtggctgtctcaactgaggatggaaaatcctttgctgagagggagtcgctctacttcatggaaacatctgctttggaagctactaatgttgacagtgcatttgctgaagtgcttactcagatctatcgcattgtgagcaagaaagctatggagaccggtgatgaggcagctgcttcagctgttccatccaaaggtgagaaaatcgatgttagtaaagatgtttctgctatgaagagagtagggtgctgctcaagctaggattctaatctgattattacattgttgagatgtggctggtttgatttgctgcgtctgtttctatgtacaccattattgtgtaaaattttctcaaagatgccaacttaggaggtcggtggattgattttattatgatcttaaaaagtttttcctcctctgttttagctgacgaacagcttaactaggaatgaagtgttacacttatggctttcaaaatggtatttaatggagctcatatttgc

SEQ ID NO: 458 - DNA, 828 bp, Populus tremula x Populus alba
caaaacttcgccttttttcaagcccaacaaaaaagaaaagaagcaggaaaaaaagagactatctttatcacgtccaacccccccattctctcttagccctagattctctcattagtttcgcttacgttatttttttttatcaaaacagagaaaaaatggcaaatgcagcgtctgggatggctgtgcatgatgactgcaagctgaagtttttggaattgaaagcaaaaaggactcaccgcttcattgttttcaagattgaggagaagcaaaagcaggtgattgtggagaagcttggtaaaccaactgatagctacgaagacttcactgccagtcttcctgccaatgagtgtcgatatgctgtttatgactttgattatgtaacagacgagaactgccagaagagcaggattgttttcgttgcatggtcccctgacacatctagggtgagaagcaagatgatttatgcgagctccaaggataggtttaagagagagttagatggtattcagatcgagttgcaagctactgatcctacagagatggggctcgatgttattagaagccgttcgtattaaatactttgcctgccatgcaagggagtccatatcattgagttcaacaagtttaatgtttatatatttgcacttagaattttcttattaaactgtcttctcctgttatgtttgtggattaatggggcgagtatcccctccagtgtggtacttacatacagttatatgatggtttgtggggggtatagatcagtttgatttgtttggaggcttttattatatgttgccctcacaaaaggatgaaatctactttcaa

SEQ ID NO: 459 - DNA, 827 bp, Populus tremula x Populus alba
agagaaaaaaaagaaaaagaagagaagtctatctttatcacctcctccacctcgcccccccctccctcctctctcttggccctagattttctctcattagtttcgcttccgttatttttatcaaatcaaaaggagaaaaaaatggcaaacgcagcatctgggatggctgtgcatgatgactgcaagctgaggtttttggatttgaaggcaaaaaggacttaccgtttcattgttttcaagatcgaggagaagcaaaagcaggtgattgtggagaagcttggtgaaccagctgatagctatgaaaatttctctgccagtctgcccgctgatgagtgccgatatgctgtttatgactttgattatgtaacagaggagaactgccagaagagcaggattgtttttattgcatggtgccctgacacggctagggtgagaagcaagatgatttatgcaagctccaaggacaggtttaagagagaattagatggtattcagattgagctgcaagctactgatcctacagagatggggcttgatgttattagaagccgttcgaattaaaatacattgcctaccatgcaaggggtccatatcattgggttcattaagtgtaatgtttatatatctgcacctagaatttgccttcttctgttatgtttgtggattcatggggcgagtatcccctccagtgtgatacttgcatacagttatatgatgttctgtgggggtatagttcagtttgatttctttgaaggcttttattatatgttgcactcgtaatagtcttttaccctactttcaattaaattatgtaccatttcattgtc

SEQ ID NO: 460 - DNA, 873 bp, Populus tremula x Populus alba
agagaaaaaaaagaaaaagaagagaagtctatctttatcacctcctccacctcgcccccccctccctcctctctcttggccctagattttctctcattagtttcgcttccgttatttttatcaaatcaaaaggagaaaaaaatggcaaacgcagcatctgggatggctgtgcatgatgactgcaagctgaggtttttggatttgaaggcaaaaaggacttaccgtttcattgttttcaagatcgaggagaagcaaaagcaggtgattgtggagaagcttggtgaaccagctgatagctatgaaaatttctctgccagtctgcccgctgatgagtgccgatatgctgtttatgactttgattatgtaacagaggagaactgccagaagagcaggattgtttttattgcatggtgccctgacacggctagggtgagaagcaagatgatttatgcaagctccaaggacaggtttaagagagaattagatggtattcagattgagctgcaagctactgatcctacagagatggggcttgatgttattagaagccgttcgaattaaaatacattgcctaccatgcaaggggtccatatcattgggttcattaagtgtaatgtttatatatctgcacctagaatttgccttcttctgttatgtttgtggattcatggggcgagtatcccctccagtgtgatacttgcatacagttatatgatgttctgtgggggtatagttcagtttgatttctttgaaggcttttattatatgttgcactcgtaatagtcttttaccctactttcaattaaattatgtaccatttcattgtccataatgaataaaccaaagagagtcatgcatgattgtgataatttc

SEQ ID NO: 461 - DNA, 1004 bp, Populus tremula x Populus alba
agcattttcatcctctctttctgtctctccagggctttacttctttgaagcaaagcaagcataatactattggtgtgacaactactaatggcagggtacagagccgaagatgactatgattacctgttcaaggttgtacttattggcgactcaggtgtgggcaagtccaatcttctttcaagattcactcgtaatgagttcagtttggagtcgaagtctactattggtgttgagttcgctactcgcagcttgaatgttgattccaaggtcattaaggcccagatttgggacactgctggccaagaaaggtaccgtgccataactagtgcttattaccggggagcagtgggtgcattgcttgtgtatgatgttacccggcactcaacatttgaaaatgttgaaaggtggctaagggagttgagggatcatacagatcctaacattgttgtcatgctcatcggcaataaatcagatcttcgccacctggtggctgtctcaactgaggatggaaaatcctttgccgagagggagtccctctacttcatggaaacatctgctttggaagctactaatgttgacaatgcatttgctgaagttcttaatcagatctatagtattgtgagcaagaaagctatggagacaggtgacaatgcagcagcttcagctgttccatccaaaggtgagaaaatcgatgtcaataaagatgtttccgctatgaagagggtggggtgctgttcaagctaggattttgatctgactattatattgtttaggagatgtagctggtttgatatgctgcgtctgtttcaatgctcaccattattgtgtaaaattttctcaaagatgccaaccataggagatcggcggattgcttttattttgatcttaagccttttcttctactgttctagttgacaaagagcttgattagcaatgaagtattacactagtcgttttcaaacctgtatgtatattttataaaaaatataaaatatttactggca

SEQ ID NO: 462 - DNA, 1069 bp, Populus tremula x Populus alba
aaaggagaaaaaaacccatcaaatgggagcctatagagctgacgatgattacgattacttgtttaaggtggtattgatcggtgattcaggcgttggcaaatccaatctcttgtctcgttttacaagaaatgaattcagtctcgaatccaaatccaccattggcgtcgagtttgctactcgcagcattcgcgttgatgataaaatcgttaaggcccagatttgggacactgctggccaagaaagataccgtgctataacaagtgcatactatcgaggagctgttggagccttactagtctatgatgtaacccgccatgttacattcgagaatgtggagagatggctaaaggagcttcgcgatcacacagatgctaacaatgtgatcatgcttgtaggaaataaagcagacctgcgtcacctccgagcagttgccactgaggatgccaagggttttgctgaaagagagagcacatttttcatggagacttctgctctcgagtcaatgaatgttgaaaatgctttcacagaagtgctgacccagatctaccgtgttgtaagcaggaaggctcttgacgttggagatgactcaacatacttgcccaaaggacagacgattaatgtcggaagcagagatgatgtctcggctgtgaaaaaggctggatgttgctcgtcatgagtattggaaagtttcgaaatattttattagcctaaagattgtcgtctttgggactccatacaggtttatctgaccatacgacaatatgctatgttgacaaaagacattcaacagtctaaatgttactattttttaagaactagagatgaatttgtagcccattttgaatcttaaatttgtcatgtttctttatttgttgttcttctccagataaagtatttgcttgcctccaccctccctccatgtgatagcagcagcctagtgctgtagttttatgtaaagtttggttgtctaggtcataaacgtgtaaagacctggctctgacggagcatgtaatactgaaagctcaaggctaaaaattcattttattggtaatattatttttcaacttat

SEQ ID NO: 463 - DNA, 1083 bp, Populus tremula x Populus alba
aaaggagaaaaaaacccatcaaatgggagcctatagagctgacgatgattacgattacttgtttaaggtggtattgatcggtgattcaggcgttggcaaatccaatctcttgtctcgttttacaagaaatgaattcagtctcgaatccaaatccaccattggcgtcgagtttgctactcgcagcattcgcgttgatgataaaatcgttaaggcccagatttgggacactgctggccaagaaagataccgtgctataacaagtgcatactatcgaggagctgttggagccttactagtctatgatgtaacccgccatgttacattcgagaatgtggagagatggctaaaggagcttcgcgatcacacagatgctaacaatgtgatcatgcttgtaggaaataaagcagacctgcgtcacctccgagcagttgccactgaggatgccaagggttttgctgaaagagagagcacatttttcatggagacttctgctctcgagtcaatgaatgttgaaaatgctttcacagaagtgctgacccagatctaccgtgttgtaagcaggaaggctcttgacgttggagatgactcaacatacttgcccaaaggacagacgattaatgtcggaagcagagatgatgtctcggctgtgaaaaaggctggatgttgctcgtcatgagtattggaaagtttcgaaatgtttctcttccgagattttattagcctaaagattgtcgtctttgggactccatacaggtttatctgaccatacgacaatatgctatgttgacaaaagacattcaacagtctaaatgttactattttttaagaactagagatgaatttgtagcccattttgaatcttaaatttgtcatgtttctttatttgttgttcttctccagataaagtatttgcttgcctccaccctccctccatgtgatagcagcagcctagtgctgtagttttatgtaaagtttggttgtctaggtcataaacgtgtaaagacctggctctgacggagcatgtaatactgaaagctcaaggctaaaaattcattttattggtaatattatttttcaacttat

SEQ ID NO: 464 - DNA, 1161 bp, Populus tremula x Populus alba
tactgttgtgacagaatttgtgcggtggaatgaggaagcaatatcaagatgcactttgttttcatctctgcctgctacccttgcagccaatgtgaaagcagtgttcacttgcttgctagaccaagtagggcaatatataacagaaggtcttgaacgagctagagatggtctcactgaagctgcaactttaagagaacggtttgtgctgggaacgagtgttagtagaagggtggctgctgcagctgcttctgctgcagaggctgctgctgctgctggtgagagcagtttcagatctttcatggttgctgtacaacggtgtggaagtagtgtggctatagtacagcaatgttttgcaaattctatatctcgccttttactacctgtggatggtgcacatgctgcttcatgtgaagaaatggcaacagctatgtccactgcagaggctgcagcatataaagggcttcaacagtgcattgaaacagttatggctgaggtagagcgattgctaccagctgaacaaaaggcaacagattataggtcacctgatgatggaatggctcctgaccatcgtccaacaaatgcttgcacaaaagttgtggcatatctttcacgtgtgcttgaggctgcattcactgcattggaaggtcttaacaaacaagcattcctcacggaattgggaaatcgcttgcacaaggggctgcttaatcattggcagaagttcacttttaatcccagtggaggattgcggttgaaacgtgatataactgagtatggagaatttgtgcgaagttttaatgctccttctgttgatgagaagtttgagttgttgggcataatggccaatgtctttattgttgctcctgaaagtctttccactttgttcgagggtacccccagcatacgcaaagatgcacaaaggtttattcagcttagagaggactacaagagtgctaaacttgcatcaagacttggttcccttgtggacaagctctagttgataaagcatcttttattttccatattttttgtatgtcttgcatgaaatgttggatacttcacacggagaactttctgtgtcggcaacagtcacctcaaattggatctgttgggacggctctgagaccaagtttttgagctagttggaaattaacttttttcgta

SEQ ID NO: 465 - DNA, 952 bp, Populus tremula x Populus alba
aacttcttgcctcttccccaagccagccagcattctattctacatggaacttcctctacagaaacagtaaaagaaaaacccaaagatctcctaaatactctttcattctctcctcctcctctccactctcccctccaatcctcagttttccgatgtcgatattcgagtacaatggaagtgccatagtagctatggtaggcaagaactgcttcgctatagctagcgaccgacgacttggagtaaaccttcaaacagtcgctactgatttccagcgaatctacaaaatccacgataagctctttgtcggtctctctggccttggcactgacgcccaaactctgtatcagaggcttgttttccgtcacaaaatgtatcagctgcgagaagaaagggacatgaaacctgagacttttgctaaccttgtttctgctgtactctatgagaaaaggttcggtccgtatttctgccaacctgttattgctggattggatgatgatgacaagccattcatttgcacaatggatttcattggggccaaggaacttgcaaaagattttgttgttgctggctcagcctctgagtccctttatggtgcctgcgaagcatttttcaagcctgacatggaacctgatgaattatttgaagttgtatcccaagcgttgctagcatcagtagatcgggactgcttgagtggttggggaggacacatctatattgtgacccctgatgatattaaagagaaaatcctaaagggaaggatggattgacagcagcccccctcatgtccaatagggcaccagatctttcttgccagaccatatacttggagtctgaacggaaacattctggtttctttgttaatgaaaagctattatcttgcagcaacggttaaattatgtgatttggataaaatttcgaagtgcattaacaaagtttaacttcattgccaaga

SEQ ID NO: 466 - DNA, 986 bp, Populus tremula x Populus alba
aacttcttgcctcttccccaagccagccagcattctattctacatggaacttcctctacagaaacagtaaaagaaaaacccaaagatctcctaaatactctttcattctctcctcctcctctccactctcccctccaatcctcagttttccgatgtcgatattcgagtacaatggaagtgccatagtagctatggtaggcaagaactgcttcgctatagctagcgaccgacgacttggagtaaaccttcaaacagtcgctactgatttccagcgaatctacaaaatccacgataagctctttgtcggtctctctggccttggcactgacgcccaaactctgtatcagaggcttgttttccgtcacaaaatgtatcagctgcgagaagaaagggacatgaaacctgagacttttgctaaccttgtttctgctgtactctatgagaaaaggttcggtccgtatttctgccaacctgttattgctggattggatgatgatgacaagccattcatttgcacaatggatttcattggggccaaggaacttgcaaaagattttgttgttgctggctcagcctctgagtccctttatggtgcctgcgaagcatttttcaagcctgacatggaacctgatgaattatttgaagttgtatcccaagcgttgctagcatcagtagatcgggactgcttgagtggttggggaggacacatctatattgtgacccctgatgatattaaagagaaaatcctaaagggaaggatggattgacagcagcccccctcatgtccaatagggcaccagatctttcttgccagaccatatacttggagtctgaacggaaacattctggtttctttgttaatgaaaagctattatcttgcagcaacggttaaattatgtgatttggataaaatttcgaagtgcattaacaaagtttaacttcattgccaagaaatgatgttgttttgaatgcggcctttacttcta

SEQ ID NO: 467 - DNA, 366 bp, Solanum tuberosum
  misc_feature (347)..(347): n is a, c, g, or t
ggactcaccgatttattgttttcaagatagaagagaagcaaaagcaggttgtggttgaaaaagttggtgagccaactcaaagctacgaggactttgctgaaagtcttcctgctgatgaatgcagatatgctgtctacgattttgacttcgtgactgaggaaaattgccaaaaaagcaggatctttttcattgcatggtcccctgacacagcaagagtgagaagcaagatgatttatgccagttcaaaggacagattcaagagagaacttgacggaattcagattgagttgcaggctactgatccaactgaaatgggacttgatgtaattaaaagccgtgcgaactangtatggatgattagatatc

SEQ ID NO: 468 - DNA, 815 bp, Solanum tuberosum
ggtagtaattaagctaagaaaatgatgaaaactctacttcttcctctttttctcctccatctaatttcatcaattataaccacatcttcttctgttagtgacattgtccgctcatcttgcgtgcacgccagctatccgacaatttgcatcagaacactctcttcctactctggctctgctattaacaccccacaggatttagctcaagccgcggtgaaaatcaccctttctcgagcacacaaagcgtctgggttcctgtctcaggtgaaagtgggaagcaaaagagagaagggggcattgagtgattgtatcgaacagatgggagactcgatggaggagctgagcaagagtttgtcagaactcaaacatctacgcaggggaaatgcattcaagtggcaaatgagcaatttggagacgtgggtcagtgctgctttgacaaatgaagatacatgtcttgatggattcaaggaaattgatggcaaaatcaggtctgatgtgaaacgaaagattactaatgttgctagagttactagtaatgcactttacctcatcaatcgacttgatgattctcgaaacaaaattcctcatccttgatcattaattcggctaattaacattaccmrgagaaacaatcgsccttccacaaatgcttcttctttttctttttctgtgttaactatgtactattttataagttaaaccagtgttattaatggtgcaatcctaaggtaagaattgtctaaattccagtttggccttgttcttatttgattttacgagataaacttatctcattcttgcccatacctacaata

SEQ ID NO: 469 - DNA, 906 bp, Solanum tuberosum
cttggaacccttcttcaatctctttgaattttcaaatacaatcaaaatggctaatgcagcgtcggggatggctgtgcatgatgactgcaagttaaggttcttggagctgaaagcaaaaagaactcaccgcttcattgtttttaagatagaggagaaacaaaagcaggttgtggttgaaaaggttggtgagccagcccaaagttacgaggatttcactgcgtgtcttcctgataatgaatgtcgatatgcagtctatgattttgatttcgtcactgcagagaattgccagaaaagcaggatctttttcattgcatggtccccggacacagcaagggtgagaagcaagatgatctatgccagtacaaaggaaagattcaagagagaggttgatggaattcaggttgagttgcaagcaaccgacccaaccgaaatgggacttgatgttattaagagccgcgccaactagatatcgactgaataggtatcagatggaccttataagaagtgaaaaactcctaatgcaatcatctttttttactttcaaggaaatatttacagtgtgacagaaacttggtatattggttgccaagtgctctacagtatatgtactttttaatgaacaagttttatggtgtttgatatatgatgtaatttgttacttttttttgttccaagttttcaactagtagcttgattctataaactaatatgtatccatttctgagggatagggtacattttagattgttttccaaaatcttcttttgacactttactttgtgattcttgttttggaatggatacaaacaaagctaattgatgttctaattagcaagtttgtatatttttgatttaattgtagtttaaaagtagttgtcaagagaaagtcatgagcattttacagtg

SEQ ID NO: 470 - DNA, 1118 bp, Solanum tuberosum
aatttttggtgagagaaagaagtcgctgtatgtggcgctgctgagaaagaggcgagaggagcagcgatggaggacgacgttgagatggcagcgggggaaaacggcgccggggaattggatgacatgaagaagaggttgaaggagatggaagatgaagcggttgctctccgtgaaatgcaggccaaggtcgagaaagaaatgggctctgttcaagaccctgctgctgctgctgcaaaccaggcaaacaaggaagaagtggattctcgatctgtctttgttggaaatgtggattattcatgcactccagaggaagtgcagcagcattttcaggcatgtgggacggtaaatagagttacaatccgaactaacaagtttgggcaacctaaaggatatgcttacgtcgagtttgttgaaccggaagctgtccaagaagctcttcttctgaatgaatctgaacttcatggccgccaacttaaggtatcagctaagaggactaatgttcctggtatgaagccataccgtgctaggcgtcctaacccgtatatgggatttcgaggccggacaccattcatgcctgctccttattttttccctccttttggatatggaaagattccaagggctagggcgccgatgcgttacagcccctacttctgagactctgttttgtttttccgtagacgtacatacctctggatggtgggacatatcattaaaagcagtagcttcttatcccctgtatggttaattgcctttacaaatcttattaatcccgaagttgagttttaaggcgagctttgtggcaaatagtgtgatgatgaatccttttggttttgtgtctgtagagttgttgagaacatatgcatgtttggaatttccactgtaatgttgcattccactgcagaaaagaaagaaagaaccgtttgggccattattgagtggttgtgtagagcttttaatttttattggattttgtggtatgtgtaggtttccggtcgcaccaatctggtgaaggaaagtcttttctttttccctccaaaagggaggctcctgatgaaagatggtacaattggtttaattttgatattattatgcaaaactaaaattttcaataattg

SEQ ID NO: 471 - DNA, 1243 bp, Solanum tuberosum
aatttttggtgagagaaagaagtcgctgtatgtggcgctgctgagaaagaggcgagaggagcagcgatggaggacgacgttgagatggcagcgggggaaaacggcgccggggaattggatgacatgaagaagaggttgaaggagatggaagatgaagcggttgctctccgtgaaatgcaggccaaggtcgagaaagaaatgggctctgttcaagaccctgctgctgctgctgcaaaccaggcaaacaaggaagaagtggattctcgatctgtctttgttggaaatgtggattattcatgcactccagaggaagtgcagcagcattttcaggcatgtgggacggtaaatagagttacaatccgaactaacaagtttgggcaacctaaaggatatgcttacgtcgagtttgttgaaccggaagctgtccaagaagctcttcttctgaatgaatctgaacttcatggccgccaacttaaggtatcagctaagaggactaatgttcctggtatgaagccataccgtgctaggcgtcctaacccgtatatgggatttcgaggccggacaccattcatgcctgctccttattttttccctccttttggatatgggtaactctatttgttctaattccatttatgaaagtatcattagttataaacaattttgtgtttgctaccctcactttctgtatataattaaatttgtgacatgacttcattaatttatgctgcagaaagattccaagggctagggcgccgatgcgttacagcccctacttctgagactctgttttgtttttccgtagacgtacatacctctggatggtgggacatatcattaaaagcagtagcttcttatcccctgtatggttaattgcctttacaaatcttattaatcccgaagttgagttttaaggcgagctttgtggcaaatagtgtgatgatgaatccttttggttttgtgtctgtagagttgttgagaacatatgcatgtttggaatttccactgtaatgttgcattccactgcagaaaagaaagaaagaaccgtttgggccattattgagtggttgtgtagagcttttaatttttattggattttgtggtatgtgtaggtttccggtcgcaccaatctggtgaaggaaagtcttttctttttccctccaaaagggaggctcctgatgaaagatggtacaattggtttaattttgatattattatgcaaaactaaaattttcaataattg

SEQ ID NO: 472 - DNA, 1093 bp, Solanum tuberosum
ggttcttcaagacataaaaaactcagtctctcttcattagcaaaagcattctgcaaaaaacttcgattcgtttctctaaatcactctccaatgtcgatctttgagtataatggaagtgctttggttgcgatggttgggaaaaactgtttcgctattgcgagtgataggcgttttggagtacagctgcagacaatcgctactgatttccagaggatttataaaatacatgagaagctttttattggactttctggcttggctactgatactcaaacactgcagcaacgcctcatgttccgtcacaagctatatgagcttagagaagatagggatatgaagcccgagacctttgccagtcttgtatctgctatgctttatgagaaaaggtttggtccatacttgtgccagcctgtaattgctggattaggagatgatgacaagccttttatttgcacaatggactctattggagcaaaggagctcgcaaaagattttgttgtttctggtactgcatctgaatcactttacggtgcctgtgaggcgatgtacaagcccgacatgggaccggaagaattgtttgagaccatctctcaggcactgttgtcatctgtagaccgtgactgtttaagtggttggggaggacatgtttatgttgtgacaccaactgaagtgacagagaggatcttgaaaggaaggatggactaaacacctgtggggtgccatacttgttcactattgcatttcactgggatgacatttcacttgttttgatgaatactcaacatttcatatttgatgttatcgtatcaacttctctccaagattgttatttaatagattcagttgtctgtcagtaatgaatgttaacattctagttagtttacaatcctctatttgagcatcccaacaaatttttgccacaacttatctgccatcacacactagacaattttgtcattaggggatacaacgtaatgccaagattttccaaaatgcgcctttgtatggttacagtggtggggtgacactgtagccaacttgattgaggaagagatgattaagtttgacattgttatatgggtatggattggct

SEQ ID NO: 473 - DNA, 1189 bp, Solanum tuberosum
gcccctttctgcatcttcttctcaaatccttccatctctcttcttcttcattttctctctctatacatacatatatcatatatataatatatatatataaacgtattgagagaccaccagtaatgggggcgtacagatcggacgacgattacgattatttgttcaaggtggtgttgatcggcgattccggcgtcggaaaatctaatcttctatccagatttacacgtaacgagttcagtctagagtcgaagtcaacgatcggcgttgaatttgctactcgtagcattcgtgttgatgataaggtcgtcaaggctcagatttgggatactgccggtcaggaacgatatcgtgcaatcacaagtgcctactatcgaggagctgttggagcattgcttgtctatgatgtcacccgtcatgtaacttttgagaatgtagagagatggttaaaagagctccgagatcacaccgactctagcatcgtcataatgctggtgggtaacaaggcagatttgcgtcatctgcgtgctgtttcaactgaggatgcccaggcatttgcagagaaggaaagtacatttttcatggaaacatccgctttggagtccatgaacgttgaaagtgccttcacagaagtgctcactcaaatacaccgcgttgttagcaggaaagctcttgaagtaggagatgacccggcagcacttcccaaggggcagacgattaatgtaggaggtaaggatgatgtttctgaagtaaagaaagctgggtgctgttctgcttagaacaaagagtaatctaaaccgcggacgagattctttttgttttgagctgaatttcacatgacatttgtacttcaacctctaaccacatgaattgcttagcactaatagctttattcactggacaactagacattgttgaattgagtgcagccccaagattgaatatccaaattagctttattcatagcattctttatccttgtttctgtattttgcttccattggtcaatgatttattgtattagctggctgcttatggacctccaaaatagggtatatttgtttcaaaaagattctgaatcgcgctatatgtatgaaactatgaacacattttatcctgccttgtaattgattgtttgattaattgtgaattgaggaatattttcaatttcttatgctatgtttgtgtaatt

SEQ ID NO: 474 - DNA, 1167 bp, Solanum tuberosum
gcccctttctgcatcttcttctcaaatccttccatctctcttcttcttcattttctctctctatacatacatatatcaacgtattgagagaccaccagtaatgggggcgtacagatcggacgacgattacgattatttgttcaaggtggtgttgatcggcgattccggcgtcggaaaatctaatcttctatccagatttacacgtaacgagttcagtctagagtcgaagtcaacgatcggcgttgaatttgctactcgtagcattcgtgttgatgataaggtcgtcaaggctcagatttgggatactgccggtcaggaacgatatcgtgcaatcacaagtgcctactatcgaggagctgttggagcattgcttgtctatgatgtcacccgtcatgtaacttttgagaatgtagagagatggttaaaagagctccgagatcacaccgactctagcatcgtcataatgctggtgggtaacaaggcagatttgcgtcatctgcgtgctgtttcaactgaggatgcccaggcatttgcagagaaggaaagtacatttttcatggaaacatccgctttggagtccatgaacgttgaaagtgccttcacagaagtgctcactcaaatacaccgcgttgttagcaggaaagctcttgaagtaggagatgacccggcagcacttcccaaggggcagacgattaatgtaggaggtaaggatgatgtttctgaagtaaagaaagctgggtgctgttctgcttagaacaaagagtaatctaaaccgcggacgagattctttttgttttgagctgaatttcacatgacatttgtacttcaacctctaaccacatgaattgcttagcactaatagctttattcactggacaactagacattgttgaattgagtgcagccccaagattgaatatccaaattagctttattcatagcattctttatccttgtttctgtattttgcttccattggtcaatgatttattgtattagctggctgcttatggacctccaaaatagggtatatttgtttcaaaaagattctgaatcgcgctatatgtatgaaactatgaacacattttatcctgccttgtaattgattgtttgattaattgtgaattgaggaatattttcaatttcttatgctatgtttgtgtaatt

SEQ ID NO: 475 - DNA, 785 bp, Solanum tuberosum
cccaaataccaattttatcggagccctaaattttctccattttttctcatcttcttccaatctgttctctctccttcaatcatggctaacgcagcatctgggatggctgtgcatgatgattgcaagctgaagtttttagagttgaaggcaaaaagaacctaccgtttcatcatctataagattgaagagaagcaaaagcaggttgttgtggaaaagcttggtgaaccaactgaaagctatgaggattttgctgcaggcctccctgctgatgagtgtcgatatgctgtctatgactttgatttcatgacagaagaaaactgtcagaagagcagaatattctttattgcttggtcacctgacacagcaagggtgagaagcaagatgatttatgcaagctctaaagacaggttcaagagagagcttgatggattccaggtagagctgcaagcaactgatcctacagagatggggcttgatgttttcagaagccgagctggtggaattgaatgttgagtgcgtgagtgtcttgtttatgttaagtgattatagttttggggaagtagaacttggttagttatactactggcttgtcgttcccgatcaccttactctttaaagtctcttcttctcagagaacttcaatactttttaatccatgttatattgttactcatgaaatcaaggagctatcttgttacattgagcatcattgttttctttacattgatcttttaagtctcatatattcagagaacttcaatagtctttgatacattctcattgtt

SEQ ID NO: 476 - DNA, 745 bp, Solanum tuberosum
aatctctttgaattttcaaatacaatcaaaatggctaatgcagcgtccgggatggctgtgcatgatgactgcaagttaaggttcttggagctgaaagcaaaaagaactcaccgctttattgtttttaagatagaggagaaacaaaagcaggttgtggttgaaaaggttggtgagccagcccaaagttacgaggatttcactgcgtgtcttcctgataatgaatgtcgatatgctgtgtatgattttgatttcgtcactgcagagaattgccagaaaagcaggatctttttcattgcatggtcccctgacacagcaagggtgagaagcaagatgatctatgccagtacaaaggaaagattcaagagagagcttgatggaattcaggttgagttgcaagcaaccgacccaaccgaaatgggacttgatgttattaagagccgcgccaactagatatcgactgaataggtatcagatggagaccttataagaagtgaaaactcctaatgcaatcatctttttttacttctaaggaaatatttacagtgtgacagatacttggtatattggttgccaagtgctctacaatatatgtactttttaatgaacaagttttctggtgtttgatatatgatgtaatttggtaacttttttttgttccaaagttttcaattagtaacattgaattctattaaactaattatgtattccatttcctgaagggataagggtacattttagattgttt

SEQ ID NO: 477 - DNA, 857 bp, Solanum tuberosum
attagctctaccagtttttcctttctccgtcttctctaatcaccagcgaatgcattaaccgatatttcaatggccggttctgaatttcctcacgcatatgcagaaacgccaagcatcaataattccgatacgctatttcaaagacgtcgtcgttgtttctgcttcccatctttccgttctccaaatcaattaacaaaatatgttaagttggactggtggcataggttacgtagcggtgcggttacggagggatctgtatgggcgaaaggaatcaacgctttgaagaagcttcgagaatggtcggagatcgttgccggaccgagatggaagactttcatccggcggttccatcggaacaaaagcggtaataggaatgcgaaattccaatatgatcctttgagttactcactgaacttcgatgaaggacggaggaataacggagaggaggaggaggaattggtacttcggaatttctcgacgagatacgcatcgattccggcgtctagtaacttcggcaaagatgggcccagtttcgtttgagtgccagagtcgcaaacagaactactatttgatagtgattggatatctagcctttccgagataaagatgaaatatttcatgattaaatttgattgataaatttatatcgtcaatcagcatataatttcgagacaattttaatccgcgagggaccctttacagttcagtagtggggctaagaaagcacagctcatcataaaagataagtaggtgcgtgcaagttttctactttttgttggtaccaccaaacaaaattattgtggatggtgtatgtggtctaatgtctttttccttgtttaatttaaattttcttctgt

SEQ ID NO: 478 - DNA, 888 bp, Solanum tuberosum
attagctctaccagtttttcctttctccgtcttctctaatcaccagcgaatgcattaaccgatatttcaatggccggttctgaatttcctcacgcatatgcagaaacgccaagcatcaataattccgatacgctatttcaaagacgtcgtcgttgtttctgcttcccatctttccgttctccaaatcaattaacaaaatatgttaagttggactggtggcataggttacgtagcggtgcggttacggagggatctgtatgggcgaaaggaatcaacgctttgaagaagcttcgagaatggtcggagatcgttgccggaccgagatggaagactttcatccggcggttccatcggaacaaaagcggtaataggaatgcgaaattccaatatgatcctttgagttactcactgaacttcgatgaaggacggaggaataacggagaggaggaggaggaattggtacttcggaatttctcgacgagatacgcatcgattccggcgtctagtaacttcggcaaagatgggcccagtttcgtttgagtgccagagtcgcaaacagaactactatttgatagtgattggtgctgattggatatcttaacctttacgaggataaaggatgaaatatttcagaacttacattttgattaaaatttatatctgtcaatccattaaatttagtcctcagcatataatttcgagacaattttaatccgcgagggaccctttacagttcagtagtggggctaagaaagcacagctcatcataaaagataagtaggtgcgtgcaagttttctactttttgttggtaccaccaaacaaaattattgtggatggtgtatgtggtctaatgtctttttccttgtttaatttaaattttcttctgt

SEQ ID NO: 479 - DNA, 1175 bp, Oryza sativa
acgccaccgcccccctcaccccgctgccgtgctcgtctcgtgctccccctctcctccgcctttagtcacctttccccctcactctctccacgcgacccagatcgatcgccgagctgcacctgcacctgcaccccgaggagaggagaggagcaatggcggcggggtaccgggcggaggacgactacgactacctcttcaaggtggtcctcatcggcgactccggcgtcggcaagtccaacctcctctcccgcttcacccgcaacgagttcagcctcgagtccaagtccaccatcggcgtcgagttcgccacccgctccctccaggtcgacggcaaggtcgtcaaggcccagatttgggacaccgccggccaggagcgataccgtgctattactagtgcatattaccgaggtgctgttggagcgttgcttgtctatgatgtcacccggcactcaacctttgagaatgttgagcgctggttgaaggaattgagggaccatacagacccaaacatagttgtcatgctagttggcaacaagtctgatctgcgccatcttgtagcggttcaaaccgatgaagggaaggcattcgcggagagagaatcgctctatttcatggagacctctgcgctcgagtccaccaacgttgagaatgcatttgcagaggtcttgacccagatctaccgcatcgtgagcaagaggtcagtcgaagcaggtgatgatgcaggttctggtcctggcaagggtgagaagatcaatataaaggatgatgtttcggcggtgaagaagggcggctgctgctcgggctaagctcttgctgtattttttttgggacctgtgtgagcttgtgttatcgccgttccagcgactgagaaattgttagtagtattagcaacttctatgttacgtagagagtttattgctataactgaaaggtttggccagatcagtttagatcttcctattgttgtatggtctccgcggcaactggggcatggtgttggttttcatgtgaatccattgcagccatgcttgaactgttgaatcaagtagaaatatgttttacgcttgcacgctgttgatttggtaaaaggggaaatgataagcagagtgtacacttgtactacatggtgggatgcaatttggcacgcaagcaaataaataacttacatttttagt

SEQ ID NO: 480 - DNA, 1145 bp, Oryza sativa
aattattttttttctctcgctcgccggagaccaaccggaatcgccgcgcgccgccgccgccgcctcctcgccgtccgccgcagccgtcgagcccatcggcgccggtcatgtcgatcttcgagtacaacgggagcgccgtggtggcgatggtggggaagaactgcttcgcgatcgccagcgaccggcgcctcggggtgcagctgcagacggtcgccaccgacttccagagggtgttcaagatccacgacaagctctacatcggcctctccggcctcgccaccgacgcccagacgctgtaccagcggctggtgttcaggcacaaactgtaccagctgagggaggagagggacatgaagccccaggcattcgctagcctcgtctccgcgctcctctacgagaagaggtttgggccgtacttctgccaaccagttattgctggattaggagataatgatgagccatttatatgtaccatggattgcattggtgccaaggaactagcgaaagattttgtggtttctggcactgcttcagaatcactatatggtgcttgtgagtccatgtataagccaagcatggaaccggaagaactattcgagacgatctcacaagcgctgcaggcttctgttgatcgagattgcctgagtggctggggtggttatgttctccttgtgactcccacagaggttcaggagagagtgatcaagggaaggatggactgagtgctcgcccgtagacctagatcgcgtaggggatggttcgttcgttcgatcgatcgattatcctgtacaactgcctacagaactaggaaaacatgtgtggtctatttacttctcaagaaacatcacagcatgaatggtatcaccgttgattccttatcttcatacccctcagggttcttctgctttccttcacatagcatggaattattaaacatgctcttgcagcacaaccgtgcaagaaaccgcaagaagctttggcctgcttggctcaggtgacaaatccattccagtgtggacaggcttcaaattctgctgctgccgccactgcctttttcttttctgaatgatggtttaattcgcttttgtttgacaatagtatcagtcatacctgctctgaaatgatggtttcctactgaatttctt

SEQ ID NO: 481 - DNA, 947 bp, Oryza sativa
ggcgagcaagcgagcgtccattccacgcgactccccaacacaaataccaccaccacctcccacacccacaccaagcgcagagctccagagagagagaagggatccatcgacgcgcgagcgctttgcttagattccttcgtcgccggcgaatccgtccccttcgcgccgcccgcaatggcgaatgcagcatctgggatggctgtggacgatgagtgcaagctcaagttcctggagctgaaggcaaagaggacctaccgcttcatcatttacaagatagacgagaagaagaagatggttgtcgtggagaaggttggcgagcccgtactgaactacgacgattttgccgctagcctccctgccaacgaatgcagatacgccatattcgactacgatttcgtgaccgaggagaactgccagaagagcaagatattcttcattgcatggtctcctgatacatcgcgcgtgagaagcaagatgatctacgcgagctccaaggacaggttcaagagggagctcgacggcattcaggtggagctccaggcgaccgatccaactgaggttggcctcgacgtgatcagaggccgtgcaaactgagcattgttttgatgctgctacctataaaagtatgagcttcagatgagaatttagagagctcccctgaggcaatgggttatgactttgttatcatcttagtactactcctatctaagggacggtgtaaggctgtaatctatgtgcggtgcaatgataaggctatcctttctgcgtttgatcatgacatctcatcgctgttcgattctttctcgctggcgtctgttatgttgaatgatgcaattcttctgtaagattccgcctttaccgaaatatctctagtatcaaatttaaattggagtacggatcctctttgaacatacggatctatttgagataattttgtctgatcatca

SEQ ID NO: 482 - DNA, 905 bp, Oryza sativa
ttctcctcctcgacttcgaacctcgacgcctgcatccgcatccgcctccgcctccgcctccgcctccgccgcgaactcgccgccgcgccggccatgtcgatcttcgagtacaatggttccgccgtggtggcgatggtggggaagaactgcttcgcgatcgccagcgaccggcggctcggggtgcagctgcagaccgtcgcgacggacttccagagggtgttcaagatccacgacaagctctacatcggcctctccggcctcgccaccgacgcgcagacgctgtaccagcgcctggtgttcaggcacaagctgtatcaactgcgggaggagagggacatgaagccccagaccttcgccagcctcgtctccgctctcctctacgagaagagatttggaccatacttctgccagcctgttatcgctggacttggagaggacaatgagccatttatttgtaccatggactgcattggtgcaaaggaactagctaaggatttcgttgtatcggggacagcatcggagtctctatatggtgcttgtgagtccatgtacaaaccaaacatggaacctgaagaactctttgagactatctcacaagctctgcagtcatcagttgatcgtgattgcctcagtggttggggaggctttgttctgcttgtgacaccaaccgaagtaaaagagtgtgtgatcaagggcaggatggactaaatttatcattgcgaagagttcttggaaccatttctgatgcctgctgttcctggtctctcagcattactatccgtgttgtatgtggattccgagggaaccttgtaatatcaaagatgttcattcacccgtagaagaaactgttgttttcttacttttctacgcttcctatgaatgaaaggacttctatttgttgcatg

SEQ ID NO: 483 - DNA, 1127 bp, Oryza sativa
ttctcctcctcgacttcgaacctcgacgcctgcatccgcatccgcctccgcctccgcctccgcctccgccgcgaactcgccgccgcgccggccatgtcgatcttcgagtacaatggttccgccgtggtggcgatggtggggaagaactgcttcgcgatcgccagcgaccggcggctcggggtgcagctgcagaccgtcgcgacggacttccagagggtgttcaagatccacgacaagctctacatcggcctctccggcctcgccaccgacgcgcagacgctgtaccagcgcctggtgttcaggcacaagctgtatcaactgcgggaggagagggacatgaagccccagaccttcgccagcctcgtctccgctctcctctacgagaagagatttggaccatacttctgccagcctgttatcgctggacttggagaggacaatgagccatttatttgtaccatggactgcattggtgcaaaggaactagctaaggatttcgttgtatcggggacagcatcggagtctctatatggtgcttgtgagtccatgtacaaaccaaacatggaacctgaagaactctttgagactatctcacaagctctgcagtcatcagttgatcgtgattgcctcagtggttggggaggctttgttctgcttgtgacaccaaccgaagtaaaagagtgtgtgatcaagggcaggatggactaaatttatcattgcgaagagttcttggaaccatttctgatgcctgctgttcctggtctctcagcattactatccgtgttgtatgtggattccgagggaaccttgtaatatcaaagatgttcattcacccgtagaagaaactgttgttttcttacttttctacgcttcctatgaatgaaaggacttctatttgttgcatgagatgtgcacttcttggcagtccttggccttgatgatgacgattatactgatcagtaagccggctactggttaattagctaagaatacgcgtatcgtggtgcaatgagctactcatactcacccttctcaggcatttgttcgttcaccgtttctatatcttggcaacactttttctgaaatggatgttagtgctttgtcgagtatggagccgacgatgtgaa

SEQ ID NO: 484 - DNA, 690 bp, Rosa hybrid cultivar
ggagtggaggtgtctcaagtttgagccaccgtctctctctctctctctctctgatcgatcacactcctccattttccctcacactaaaaccaatacacccattctcatcttggcctcaatcttctgcaacaaccatggccaatgcggcgtcgggatttgctgtggatgatgattgcaaactaaagttcttggacttgaaggccaaaagaacttaccgcttcatagtattcaagattgaggagaagcagaagcaggtgattgtggagaaattaggtgagccagctcaaagctatgaagayttcacygcaagycttccwgctgatgaatgcagatatgctgtctatgattttgaytttgtgactgctgaaaactgtcagaaaagcaggattttcttcattgcatggtcccctgatacatcaarggtgagaaacaagatgatttatgcaagctcsaaggacaggttcaagagagaattggatggtatccaaatagagctgcaggccactgacccaactgagatggatcttgatgttatcagaagtcgtgccagctaagaagttgtgtttgcaatggcgattttccttaagtttcttttttcaatttatgccaatgttaatagtttgtggggctgtgaacctaactgaattatgatatttggtttgctattaaatgtttatcttcatgtagaat

SEQ ID NO: 485 - DNA, 839 bp, Rosa hybrid cultivar
agagatcttttcaagaacgtacctgttgtcttgtgttacagtgagaaacaaaaagaagaagaagaaaccaatggccgggtacagagctgaggacgactatgactacctcttcaaggtggtgttgatcggcgactcgggtgtgggcaagtccaacttgctctccagattcacccggaacgagttcagcctcgagtccaagtccacaattggggtcgagttcgccacccggagcttggatgtggacggaaaagtcatcaaggcccagatttgggacactgccggccaagaaaggtacagagcaataactagcgcttattatcgaggggctgtgggtgcactgcttgtgtatgatgtcactcggaattcaacatttgaaagtgtggaaagatggctgagggagttaagagaccatactgatcccaacattgttgwcatgctggttggtaacaaatcagatctacgccaccttgtggcagtctcaactgaggatggaaaatcctttgccgagagagagtccctctacttcatggaaacttctgcactcgaagcaactaatgtggacaatgcatttgctgaagtccttacccagatctttcgcatagtaagcaagaagaccatggaggctaacaatgatgcagctgctgttccttcccaaggagagaaaattgatgtcagtaaagatgtttcagctgtgaagaaaggcgggtgctgttcaagctagattttgaatctgcatcagatttgtctggtttatgttgccacatctgtttctctgtataccggggtattgtgtaaaatttttcatcccaagacagtaagtgctaagtgggggttcattt

SEQ ID NO: 486 - DNA, 651 bp, Rosa hybrid cultivar
gaccctaaaattccctgcaacatttttctctgcaaaatggcaaacgcagcatctgggatggctgtgcatgatgactgcaagttgaagttcttagacttgaaggcaaaacgaacttaccgcttcatagtttacaagattgaggaggagcaaaagcaggttggggtggaaaagcttggtgaaccaagtcagagctaccaggatttctctgcctgcctccctgctgatgaatgccgatacgctgtctacgactttgattatgtgacagaagagaactgccagaagagccgcattattttcattgcttggtcccctgacatatcaagggtgagaagcaagatgatttatgccagttcaaaggacaggttcaagagagagttggatggcattcaggttgagttgcaagctactgaccctattgtttttttttttgatgtgattagaagccgcgctaattaaattaaagcattggcaatgcaatttggagggtcctctacactatctggtctattatgcgacatgtctatagcctatggacatgaattgtctttactattgtattcggttggtgacataatttgtaatctgtggatgattggtacctcattttggtgtgaaatacatacttatggcccatttcccaaaaaaaaaaaa

SEQ ID NO: 487 - DNA, 513 bp, Sesamum indicum
gcctcgttctcttcctgaagctccagaaatggcaaacgcagcatctgggatggctgtgcatgatgactgcaagttgaggttcttggaactaaaggcgaaaaggacttatcgtttcattatctttaagatagaggagaaacagaagcaggttgttgttgaaaaagttggtgagccaactcaaagctatgacgacttcactgctagtcttcctgctgatgaatgtcgctatgctgtgtatgattttgactttgtcactgcagagaattgccagaaaagcaggatattcttcattgcttggtctcctgacacttcgcggatcagaaacaagatgatttacgctagctcaaaggacagatttaagagggagctggatggaatccaagttgaattacaggcaactgatccaactgaaatgggtcttgatgtcattaagagtcctgctaactaagtgagaatttgtaggccttctgcggcagacttgctctgttgacctttacttgaaaaagaatgcct

SEQ ID NO: 488 - DNA, 906 bp, Sorghum bicolor
cgccgtcgctagtcgctacttcccctccgactccgatcctcgacgccgacgcatccaccggaaccctcctcctccgccgtcgctatgtcgatcttcgagtacaatggatccgccgtggtggcgatggtggggaagaactgcttcgcgatcgccagcgaccggcggctgggcgtgcagcttcagaccatcgcgaccgacttccagcgggtgtttaagatccacgacaagctctacatcggcctctcggggctcgccaccgacgcccagacgctgtaccagcggttggtgttcaggcacaagctgtatcagctgcgggaggagagggacatgaagcctgagacctttgccagccttgtctctgcgctcctctacgagaagagattcgggccatatttctgccagccagtcattgctggacttggagatgatgatgtaccttttatttgtaccatggactgcattggtgcaaaggaactggccaaggattttgttgtttctgggacagcgtcagaatctttgtatggtgcctgtgaatccatgtacaagccaaatatggaacctgatgaactattcgagactatatcccaagctctgaattcttcagtagaccgtgactgccttagcgggtggggtggctatgttctgattgtgacgccgactgaagtgagggagcatgtgattaagagcaggatggactaaatcatggccactagagttcttagcttgtttccaatgcttagaccaatgttgtgtttggattttgaagtaacattgtatcatcmcmcagttggtatgagaaggaaccctttgttttctttacccctgttttgcaagacttctgcctggatttcagctgaatgggtggatgacttgataatatcctagattgaggaattgttctcttgt

SEQ ID NO: 489 - DNA, 958 bp, Sorghum bicolor
gcacgaggcttttcttttctttttttccctttccgccggcggaaaacaacctgagtcgccgccgtctccgttctcgccgtcgcctctcctgccgccgctcccgcaggccacatcagcgccaaccatgtcgatcttcgagtacaacgggagcgccgtggtggcgatggtggggaagaactgcttcgcgatcgccagcgaccgccgcctcggcgtgcagctgcagacgatcgccaccgacttccagcgggtgttcaagatccacgacaagctctacatcgggctctccgggctcgccacagacgcccagacgctgtatcagcgactggtgttcaggcacaagctgtaccagctgagggaggagagggacatgaagcccgagacctttgccagccttgtttcagccctactctatgagaaaaggtttgggccatacttctgccaaccagttattgctggcctaggagacaacaatgagccatttatatgtaccatggattgcattggtgccaaggaactagcaaaagattttgtggtctctggtactgcttcagaatcactttatggtgcttgtgagtccatgtataagccaaacatggaacctgaggaactgttcgagacaatctcacaagcattgcaggcgtctgttgatcgtgactgcctcagcggctggggaggttatgttcttattgtcacacccactgaagtgcaggagagagtgctgaagggaaggatggactaagtgctgccatgtagttatttaggagattgtttcttcattcggcctgccctgccctgtactacggcgtacagaattcagaaaacctgtgcactacattacttctgaaatgaacattgattcagtagttgccttcgtctttctgtgctgtttctgccccagcactttagaattgcttgacttgtggcacttcagttatggtataatcgacatacctgtttg

SEQ ID NO: 490 - DNA, 1229 bp, Sorghum bicolor
gcacgagggttccaagaacacatgtcgtctttcaaacaaagttcgggcacctctcgaggggtttatgttttttctgagaacaacccgtatgttggtcaccctaatccaatgcaggaaggacaggagctcttccgcaagggcctcttaagtgaagctgttcttgctttagaggctgaagttttgaagaatcctgataatgctgaaggttggaggttgttaggcgtaaccatgcagaaaatgatgatgaccagcaggccattgcagcaatgatgcgtgcgttggaagctaatccgacaaaccttgaaattcttcttgctcttggtgttagtcacacaaatgaattggagcagggagaagcgttaaggtatctttctaggtggcttcagaatcatccaaaatatggtggccttgtccctccgcagtcaactgattcaccttatggtcctgatgttgttagattgtttaatgaagctgctcagatgtcacctgaagatgcagatgttcatatagttctgggagtcttatacaacctatcaagagagtatgataaagctatagcttcatttaagacagcactgcagctcaaaccacaggactattcactctggaacaagcttggtgcaacccaagcaaacagcatccagagtgctgatgcaatattggcgtatcagcaggctctagacttgaaacccaactatgtgcgtgcatgggcgaatatgggaatcagctatgccaaccagggtttgtatgaggattccattcggtactatgtaagggcagttgcaatgaacccaaaagctgacaatgcctggcagtacttgaggatttctcttagcaatgcttcgcgagctgacatgattgctgcatgcgacgcccgcaaccttgacgctcttcagaaagagtttcctctgtgagtcctccctcaaagacattagctatccagcagagatcttcatccatggaaggaagcagcacactagcaagccacgtgataatggtaccattggctgcactcaggatcatggacatggacgtggaaaccagtagcatcttgtatttgcctgttgattcttctatttattttacaaagtgtggggatgtatagggagtagggaaacaacatccagttgatgtgaagtatcatggcgtgaggctatagtggcaaagggggattatacatctgtaagtacacacttacggaaggcacaacaggaataaaagaatggttg

SEQ ID NO: 491 - DNA, 1245 bp, Glycine max
caaaggattaaaagcatgtacttttaaaggtcagatactaaaattaaaattcagcaaaataaaaactaaaaacattttttatctttaagtttcatgcttaatatggtaaaaaatgaaaaataaatttcaaccctgagtccccaaactccaaagtgccagactagtctcagatgtacgtgcaaatcaatacaaagaagaaaataaaaataaaaataaaaaatcattagtagtggcgctttttaaagcgttttcatactctagtgtttcttttctttcttcctttccttgtttccactacttttcttcccttctttccagaacaacaccacaacacaaacagagcaaaaaaagctccaccaatggcgggttacagagccgacgacgactacgactacctcttcaaggtggtcctgatcggcgattccggcgtgggcaagtccaacctcctctctcgcttcaccaagaacgagttcaacttggagtccaagtccaccattggcgtcgagttcgccacccgcaccttgaacgtcgattccaaagtcatcaaggcccagatctgggacaccgcaggccaagaaaggtatcgtgccatcaccagtgcatactatcgtggggcagtcggtgcacttctcgtgtatgatgtcactcgccatgcaacatttgaaaatgttgacagatggctgaaagaattgcggaaccacacagatgccaacattgttgtgatgctcgtgggtaataaatcagaccttcgtcaccttgtagccgtgtcaactgaagatgggaagtcctatgctgagaaggaatcactttacttcatggaaacctcagctctggaggctactaatgtagagaatgcctttgccgaagttctgactcaaatctatcacattgttagcaagaaagcagtagaggtggctgaaaatggaaccacatctgtgcctgccaaaggagagaaaattgatctgaaaaatgatgtttctgctttgaagagagttggttgctgctcaagctaagattggaaaacatagttcaattggttggtatcggctctgttgtacgtgtaatattctgagaaatacgaactagaagaaaagtgaaatttaatttgtcatagcatgttagactctttgtgtaaccttaaaactaagtttggtgtttcaataggagctgctggtgaagcaggttgattgctagtcttacttgttgtagtgcttttattattgtttttgaaatgttttcacatgc

SEQ ID NO: 492 - DNA, 1007 bp, Glycine max
ttcccaaatttctcattctcccatttcctctcagaaccctcgatcactcccacgcgctcctatatcctctccttcaccgtcgctctctccaacgatcacaacaacatcgtcatcccatggcaaacgccgcatctggtatggcagtccatgatgactgcaagttaaggtttttggagctgaagacaaagaggacacaccgtttcatagtttttaagattgaggagcagcagaagcaggtcattgtggagaagcttggtgagccagcccaaggctatgaagatttcactgccagccttcctgctgatgagtgccgttatgctgtttatgattttgagtatctgactgaagggaatgtccctaaaagcagaatttttttcattgcatggtcccctgacacatcaagggtgaggagcaagatgatctatgcaagctccaaagacagattcaagagggagctggatggaattcaagtagagctgcaagcaactgatcctactgagatgggtcttgatgtgttcaaaagccgggccaactaaaatgattatagaaaatagtaggctttctggtgggagcagcactccttaagccttagttactcatggaaaatatcctagtttgtgggatggtcaacttgggtagttatggtcccaaactctctcaattttccaagttgtggcataaattctattgcaccttttaacaagctttgcttgttccagtgtgttttattatgatttgtgatttatacaaccttgcgtttgagtgccattttagtcgtcttatcccttactagttgaatttgtaactgtttgtgttatcagacaaaaaatggggtttcttcacttattgacactcgtcatccactaatgttttgtgacttgttctggccgatatatgctttcttttgtatgggcatacaaaggcctcttgtttgctatattccttttttgttttatgttttgggagaatgagatttattcaattggttgggtgttcttacttgaaaa

SEQ ID NO: 493 - DNA, 963 bp, Glycine max
gggacaaaacactatttgacgacttaaccccaaacgaagaaaaaagactgagagcaattgcatcaacaacaaattgaaaggatgtcgatcttcgagtacaacggaagcgccgtggtggctatggtcggcaagaactgcttcgccattgccagcgaccgaaggctcggcgttcagctccaaaccatagccacggatttccaacgcatttccaagattcacgacaagctcttcatcgctctctctggcctcgccaccgatgctcaaacattgtatcagcgtcttgttttccggcacaaactgtatcagcttcgtgaagagagggatatgaaaccagagacctttgccagcttagtctctgctctgctttatgagaaaaggtttggtccatacttttgtcagcctgtaattgctggattaggggatgaagacaaaccattcatctgcacaatggattgtcttggggcaaaggagcttgcaaaagattttgttgtttctgggactgcatctgagtctctgtatggtgcttgtgaggcgatgtttaagcctgacatggaaccagaggaattgtttgagaccatctcccaagcactgctatcatctgtagatcgtgattgtttgagtggctggggaggacatgtctatgttgtcacgccaaccgaagtgaaggaaaggattttgaagggaaggatggattaacttgtaagccacctgagttttctgtttagtttggagttgaatggcatgacatttacaatcctttgttaaagggtacctttgttattgtggctctttagataaatgtatcctgaaaattatttatagacggttcacttgttctatattttagattatcagtgaaaggaggagattcttgagttgggcatgttgtgagtgatctattggaatgtttttcagtgcagactggcatgcaaagcacgataatgatactagaattgcctcaaa

SEQ ID NO: 494 - DNA, 961 bp, Glycine max
aattcggcaccagcccaaacaaaggctctgcaattgcaaattcagaggatgtcgatcttcgagtacaacggaagcgccgtggtggctatggtcggcaagaactgcttcgccattgccagcgaccgaaggctcggcgttcagctccaaactatagccacggattttcaacgcatttccaagattcacgacaagctcttcatcgctctctctggcctcgccaccgatgctcaaacattgtatcagcgtcttgttttccggcacaaactgtaccagctgcgtgaagagagggatatgaaaccagagacctttgccagtttagtctctgctctgctctatgagaaaaggtttggtccatatttttgccagcctgtaattgctggattaggggatgaagacaaaccattcatttgcacaatggattgtattggcgcaaaggagcttgcaaaagattttgttgtttctggcactgcatctgagtctctgtatggtgcttgtgaggcaatgtttaagcctgacatggaaccagaggaattgtttgagaccatctcccaagcactgctatcatctgtagatcgtgattgtttgagtggctggggaggacatgtctatgttgtcacgccaaatgaagtgaaggaaaggattttgaagggaaggatggattgaattataagccacctgggatttctgtttagcttggagctgaatgtcatgacatttaccctcctttgttttaaagggtaccttgttattgtggctctttagataaaatgtaccctgaaatttatatattgacggtttcacttgttctatatttagattatcagtgaaaaggagatacttgagttgggcatgttgtgaatttgagtggcctattggaatgtttttcagtgcagactggcatgcaaagcacgagaatgatacaagaattgcctcaaatctatttctcccgtttttttcttcc

SEQ ID NO: 495 - DNA, 1926 bp, Glycine max
gcaacaatatgcctccaatcttgccggatttctccaactcggtgaaactcaagtacgtgaaactagggtaccaatacctggtgaaccacattctgactctcactctcatacccatgatgatcgccatcttcatggagattctacgcttaggccctgaagagatcctgaacctctggcactccctccacttggaccttgtccaaatcctctgctcckccttcctcatcatcttcatckccaccgtctayttcatgtccaarccccgcaccatctacctcgtcgactacgcctgcttcaagccwcccgtcacytgccgygtccccttcgcaaccttcatggaacactccaggctcatccttaaagacaaccctaagagcgtcgagttccaaatgcgtattctcgaacgttccggtctcggtgaagaaacatgtctccccccagcaatccactacatccctcccaagcccaccatggaggccgcccgaggagaagccgaacttgttatcttctccgccatggattctttgttcaacaaaacaggtctcaagcctaaggacatagatattcttattgtcaattgcagtcttttttctcccactccttctttgtctgctatggtcatcaacaagtacaagctcaggagcaacatcaagagcttcaacctctccggcatgggttgcagtgctggcttgatatccgttgacttggctcgtgaccttctccaggttcaccctaactcaaacgccgtcgttgtaagcaccgagatcatcacccctaactactaccaaggcaaagagagagccatgcttcttcctaattgcctcttccgaatggggggtgctgctattctcttatccaaccgaacctccgaacgcaggagagccaagtacaggttggtgcacgttgttcgcactcacaaaggcgctgatgacaaagcctaccgttgcgtttttgaagaggaagacagagaagggaaagtggggatttcacttcagaaggatctcatggctattgcaggtgaggctctcaagtctaacattactactatgggtcctcttgttcttccggcttccgagcagttgctgttccttctcactctcattgggaggaaaatcttcaaccccaaatggaagccttatattcctgacttcaaacaagcctttgagcacttctgcatccacgctggtggacgtgctgtgattgatgagcttcagaagaatcttcagctttctactgaacacgttgaggcttctagaatgacccttcacaggtttgggaacacttcgtcttcttcgctgtggtatgagctcaactacattgagtccaaggggaggatgaagaagggtgatagggtgtggcagatagcgtttgggagtggctttaaatgcaacagtgctgtgtggaagtgcaacagaagcattaagacaccggttgatgggccttgggctgattgcattgatcgttacccggtcgatattcctgagatcgttaagctctaggatggagaattgttcaagaacaagaagataattgcttattttatgaaaaaaaaaaatagatgagttctcataacccttctctatctgctcaccgtagccgtaccacaaatctctctcatttgtcagtcatattggttattttatcatatatcatatcccacttttatatatatatattttttttctgtttatttcaaaacaattacatgggcctcttgtgaattagcacagaaatcgatcgccaactgggagggggtctgtgtttattcatgaatttgtgcaacatgtacgtaaggaaaacacagtttctatttcaagtttgtatttgcttgcactattattggaaagcttgtaattaggacttgaaatgtaagaagtgctttgctttgttgttgttgtcttgtcagcgagatcatatcattaaatt

SEQ ID NO: 496 - DNA, 1149 bp, Glycine max
ccacgcgtccgtatcattcgagctctgaatgcttctccctccataataacaaaaccaacaccctctttctctttctctcttcttcatttccaatgctgcagcaatctgcaagcttcataggcactacgacagacccaattgaattcccgagaaagaattgaagagaaaaaaccgtaaagttaggatcttttgtgtgatttcgatgggtgcgtacagagcggacgatgattacgactacttgttcaaggtggtgttgatcggagactcaggcgttgggaaatcgaacctcttgtctcgtttcacgaagaacgaattcagcttggaatccaaatccaccattggcgtcgaattcgccacccgcagcatccacgtcgatgacaagatcgtcaaggctcaaatttgggacacggcaggccaagaaagatatcgcgcaatcacaagtgcatattatcgaggggctgttggtgcactgcttgtgtatgatgttaccagacatgtgacttttgaaaacgtggagagatggttaaaggagcttcgtgatcacacagatgccaacattgtaatcatgcttgtggggaacaaggcggatcttcgtcacttgcgtgctgtctccacagacgatgccaaggcatttgccgagagagaaaatacgtttttcatggaaacatctgctcttgagtccttgaatgtcgataatgccttcaccgaagtgctcactcagatataccgcgttgttagtaggaagactcttgagattggggatgaccctgcagccttgcccaaggggcagaccatcaatgttggcagtagggatgatgtctcagctgttaaaaagtctggatgctgctctgcttagtttcacaagccttttgcagcagaatagaataatatctatatgtgcatgattcaaccaattctcaacattttggagtccaagtgaaatcttttaatacctacacttctctttttatgtagtttttcccacatatcttggcaagtttattgttttctctttttctttttcttttcttttcatgtaagtgtttggtcataggaatgatgtcttgttgttcttaaatatacaaaatatactgtttgtattgagtgaaagtgatattkggttctyagattgatcagaagttacaaaaa

SEQ ID NO: 497 - DNA, 1139 bp, Glycine max
ctccataacaacaacaacaacaacaacgctctcttaatctttcttttttcatttccaatgctgcaacaacttgcaaggttcatatgcagcactacgacagacccaattgaattcccacaaaagaattaaagaaaaaacggtcaagttagaatcttttgaacctttcgatcgcgtgggaaggaagagaggaagatgggtgcgtacagagcggacgatgattacgactacttgttcaaggtggtgttgatcggagactcaggcgttgggaaatcgaacctcttgtctcgtttcacgaagaacgaattcagcttggaatccaaatccaccattggcgtcgaattcgccacccgcagcatccacgtcgatgacaagatcgtcaaggctcaaatttgggacacggcaggccaagaaagatatcgcgcaatcacaagtgcatattatcgaggggctgttggtgcactgcttgtgtatgatgttaccagacatgtgacttttgaaaacgtggagagatggttaaaggagcttcgtgatcacacagatgccaacattgtaatcatgcttgtggggaacaaggcggatcttcgtcacttgcgtgctgtctccacagacgatgccaaggcatttgccgagagagaaaatacgtttttcatggaaacatctgctcttgagtccttgaatgtcgataatgccttcaccgaagtgctcactcagatataccgcgttgttagtaggaagactcttgagattggggatgaccctgcagccttgcccaaggggcagaccatcaatgttggcagtagggatgatgtctcagctgttaaaaagtctggatgctgctctgcttagtttcacaagccttttgcagcagaatagaataatatctatatgtgcatgattcaaccaattctcaacattttggagtccaagtgaaatcttttaatacctacacttctctttttatgtagtttttcccacatatcttggcaagtttattgttttctctttttctttttcttttcttttcatgtaagtgtttggtcataggaatgatgtcttgttgttcttaaatatacaaaatatactgtttgtattgagtgaaagtgatattkggttctyagattgatcagaagttacaaaaa

SEQ ID NO: 498 - DNA, 883 bp, Glycine max
  misc_feature (6)..(6): n is a, c, g, or t
gttgcngtcgcttcgttccttccccaacccaatcttcgccttcgcccacaacaactcctccttcaggatcgctgccaacgttactttccatttttacccttcatcctcgagaaaaaaatggcgaacgcagcatctggtatggccgtccatgatgagtgcaagctaaagtttctggagctcaaggcgaagaggacgtaccggtatatcgtttttaagattgaggagaaatcgaagcaagttattgtggagaagctgggtgaccctgcaaatggctatgatgaattcgctgccagtcttcctgctgatgagtgtcgatatgctgtttatgattttgattttgtcactgaagagaattgccaaaagagcagaattttcttcattgcttggtcccctgatacatctagggttaggagcaagatgatttatgccagctccaaagatagattcaagagggagcttgatggaattcagattgagctgcaagcaactgatcctactgagatgggtcttgatgtgttcaaaagccgtgccaattaaatgattccgattattcataaataggagttgtgatggggatggtcaacttggctaatttggactcaattttccaagttttgacatgaggtctattgcagcttcaacaaagcttctcttgttccagtgtatcttgtggtttgcgacatataacccgtgtttgggtgtaatcttagtcctattcctagtagttaattttgtaactgttctttgtgtgattgaacgaaaatttgggaccaggtattgatgtaatgttgccagttgccatcttactaatgtcttatgacttaaattaactaaaatactttcttgaaaacaatttaatacatattatgaactatgttatcat

SEQ ID NO: 499 - DNA, 975 bp, Glycine max
atatgtcaaacctctctaaacttcacatatagtattaactaactttaccatcgcgcaagggtttacatcggaaaagttggtagcgaaagaaagatgtcgatcttcgagtacaacgggagtgccctagtggctatggtggggaagaactgcttcgccatcgcgagcgatcggagactcggggttcagctccagaccattgccaccgatttccagaggatttcaaaaatccacgacaagctcttcatcggtctctccggcctcgccaccgacgcccagaccctctaccagcgcctccttttccgccacaaattgtatcagctccgcgaagagagggacatgaagccccaaacctttgccagcctagtctccgctattctctacgagaaaaggtttggtccatacttttgccagcctgtaattgctggactaggagatgatgacaaaccattcatttgcacaatggatgccattggagcaaaggaacttgcaaaagattttgtagtggctggcactgcatccgagtctctttatggtgcttgtgagtcaatgtttaagcctgacatggaaccagaagaattgttcgagacaatctcccaagcactgctatcatctgtagatcgtgattgtttaagtggctggggtggacatgtttatgttgtcaccccaaccgaagtaaaggaaaggatactgaaaggaagaatggactaacttttaagcgtgtttgttttgacgtactcctactttccgaggagcctgaacgtgaaaggggaaatttgttggattgacgttcatcaccatttcaaatggaaaaacaaatatgctatgatccaaccaaatcactcttttcttgtcattttgttatcctagtttggatttaattgaaaatcatttaccatcaatttgtgcagacggsctatacctttattaactgttagaaagttttactctgtttcagtgttaagcagctacttccgt

SEQ ID NO: 500 - DNA, 879 bp, Glycine max
attcccaaaatttctcattctccctttcctctccgaaccctcgatcactctcacgcgctcctatattcgctcctccaccgtcgctctctcgaacaaccacaacaccatcttcatcacatggcaaacgcagcatctggtatggcagtccatgatgactgcaagttgaggtttttggagctgaaggcaaaaaggacacaccgtttcatagtttttaagattgaggagcagcagaagcaggtcattgtggagaagcttggtgagcctgcccagggctatgaagatttcactgccagccttcctgctgacgagtgccgttatgctgtttatgattttgagtatctgactgaagggaatgtccctaaaagcagaatttttttcattgcgtggtcccctgacacatcaagggtgaggagcaagatgatttatgcaagctccaaagacagattcaagagggagctggatggaattcaagtagagttgcaagcaactgatcctactgagatgggtcttgatgtgttcaaaagccgtgccaactaaaatgattatataaaatagtaggctttctggtgggagcagcacccctgaagccttagttactcatatggaaaatatcctagtttgtgggatggtcaacttgggtagttatggtcccaaactctcaattttccaagttgtggcataaaattctattgcaccttttgacaagctttgcttgttccagtgtgttttattatgatttgtgatttatacaacctttgcgtttgagtgccattttagtcgtcttatcccttactagttgaatttgtaactgttttgtgttatcagacaaaaaatgggggttcttcacttattgacactcgtcatccactaatgctttgt

SEQ ID NO: 501 - DNA, 1012 bp, Glycine max
tctttcttcctttccttcttttcactacttgtctcttccctttttctttccagaacaacagaacaacagagcaaaaagctccaccaatggcgggttacagagccgacgacgactacgactacctcttcaaggtggtcctcatcggcgactccggcgtgggcaagtccaacctcctctcgcgcttcaccaagaacgagttcaacctggagtccaagtccaccattggcgtcgagttcgccacccgcaccttgaacgtcgattccaaagtcatcaaggcccagatctgggataccgcaggccaagaaaggtatcgtgcgatcaccagtgcttactatcgtggggcagttggtgcacttcttgtgtatgatgtcactcgccatgcaacatttgaaaatgttgacagatggctgaaagaattgcggaaccacacagacgccaacattgttgtgatgctagttggcaacaaatcagaccttcgtcacctcgtagcggtgtcaactgaagatgggaagtcctatgctgagaaagaatcactttacttcatggaaacctcagctctggaggctactaatgtagagaatgcatttgctgaagttctgactcaaatctaccgcattgttagcaagaaagcagtagagggggctgaaaatggaactgcatctgtgcctgccaaaggagagaaaattgatctgaaaaatgatgtgtctgctttgaagagagttggttgctgctcaagctaaaattggaaaacatagttcaattggttggtatcggctctgttgtatgtgtaatattctgagaaatacgaactagaagaaaagtgaaatttaatttgtcatagcatgttagactctttgtgtaaccttaaaaactaagtttggtgtttcaataggagctgctggtgaagcaagttgattgctagtcttacttgtagtgctgttattgtttttgaaatgttttcacatgcaaagtggttcaagcttggaattacttcatttaagtttgtgtagta

SEQ ID NO: 502 - DNA, 1237 bp, Glycine max
tagtaaataatttcttattacaaaaaaatctcaacaattttatttatccaatatatgactgtgtatatcaacataaatgaataataaacaatgttgacaatccaacacactgatccttccagtcaaaacacagaacttcagaggaatttatagaacgcacacagttaattggacgaatttagatgatcaaatttaaacgagggcaatgctgcttcctccaccggggggtctgcgggcacctagtatatggtctctactttctgcctttccatcggcaaatatgtcactcccagccatttctctaagtttagctctgcttgaaggcttttccggtgatcctgcaggaacgtctcccttgaaaatattattgcctgtcatctctgcacctcgtgccgaattcggcacgaggcaacccaacccaatcttcaccttcgcccacaacaaatcccattcctgcatctcctccttcagcatcgctgcaaactttactttccatttttgtccttcctccccgagaaaaaaatggcgaacgcagcatctggtatggccgtccatgatgactgcaagctaaagtttttggagctcaaggcgaagaggacgtaccggtttatcgtttttaagattgaggagaagcagaagcaagttattgtggagaagctgggtgagcctgcaaatggttatgatgatttcgctgccagtcttcctgccgacgagtgtcgatatgctgtttatgattttgattttgtcactgaagagaattgccaaaagagcagaattttcttcattgcttggtcccctgatacatctagggttaggagcaagatgatttatgccagctccaaagatagattcaagagggagcttgatgggattcagattgagctgcaagcaactgatcctactgagatgggtcttgatgtgttcaaaagccgtgccaattaaatgattctgattatgcataataggagttgtgatggggatggtcaacttggctaatttggactcaattttccaagttttgacatgaggtctatagcagcttcaacaaagcttttcttgttccagtgtatcttgtggtttgtgacatataacccgtgtttgggtgtcatcttagccctattcctactagttaattttgtaactgttctttgtgtgattggacgaaaatttgggatcaggtattgatgtaatattgccagttgccatcttattaatgtcttgtgacttaaattaacta

SEQ ID NO: 503 - DNA, 1375 bp, Picea sitchensis
tcccccccggtgaaagcggtcagagctaaggcattttacagagacagcagaggtccgaaccagggtttcatttaccttctaaatagtgcaaaacaacgaggcacgccgagggcattttgtagaagaaatttgcagtaacaggcgcaggggaaggacaaggccggctcactatttctgtatttatacatgcacaaataactatattattatacaaagaaaactagctgcagcttgaggagaaagactcagttcttctacacctcctacatctgtctcagcaatgtcgatatttgaatataatggaagtgctttggtggctatggttgggaaaaactgctttgccatcgccagtgatcgtcgtttaggtgtgcaattgcaaacaatagctactgattttcagcgcattttcaagattcatgataagctctacgtgggtctttctggattggctacagatgtgcagactttgtaccaaagatttgcttttcgccataagctttatcagctgcgtgaggaaagaaatatgaggccagaaacttttgcgagtcttgtttctgcgttactttatgaaaagaggtttggtccttacttttgtcaaccagtgattgctggattaggggaggatgataaaccgtttatatgcactatggattcgattggtgccaaggaactggcaaaggactttgttgtggctggtactgctgcagagtcactttatggtgcatgcgagtctatgtacaagccagacatggaaccggaagagctatttgagacgatttcccaggctttattgtcatccatcgatcgtgactgtttgagtggctggggaggccatgtttatgtcgtgtcaccaaatcaagtgattgagcgcacattgaagggacgcatggactgagccatttttcttgcaagagaaattacatgtcatagcagtgttattggtgtctattaaatgaacagaattgtactttagtacatagtggagttaagagtcgttcaaaccattaatacatttgatgtcattgcacaagaagccacctttcattacttgcctctaagttcaatcctctagaggccaatgcgaactgaatcttttactgcatctctaatcaatttgcaagcaagtctttcaatggaccaagcttacaaataatcagatttcaatttcctaattttgaaatggtacattttgagggagcaaaatcttctgaawttttgtactcttatgtgagagactgatttctttgcttgttttaaattggcgatcctttcagaaagtagctatccagtcaataaagctagtatcaggtaaaatattgctcgtcaactgtttcacatytgcaaatgagaacywtcggtgctaaaacgttttgca

SEQ ID NO: 504 - DNA, 1334 bp, Picea sitchensis
tcccccccggtgaaagcggtcagagctaaggcattttacagagacagcagaggtccgaaccagggtttcatttaccttctaaatagtgcaaaacaacgaggcacgccgagggcattttgtagaagaaatttgcagtaacaggcgcaggggaaggacaaggccggctcactatttctgtatttatacatgcacaaataactatattattatacaaagaaaactagctgcagcttgaggagaaagactcagttcttctacacctcctacatctgtctcagcaatgtcgatatttgaatataatggaagtgctttggtggctatggttgggaaaaactgctttgccatcgccagtgatcgtcgtttaggtgtgcaattgcaaacaatagctactgattttcagcgcattttcaagattcatgataagctctacgtgggtctttctggattggctacagatgtgcagactttgtaccaaagatttgcttttcgccataagctttatcagctgcgtgaggaaagaaatatgaggccagaaacttttgcgagtcttgtttctgcgttactttatgaaaagaggtttggtccttacttttgtcaaccagtgattgctggattaggggaggatgataaaccgtttatatgcactatggattcgattggtgccaaggaactggcaaaggactttgttgtggctggtactgctgcagagtcactttatggtgcatgcgagtctatgtacaagccagacatggaaccggaagagctatttgagacgatttcccaggctttattgtcatccatcgatcgtgactgtttgagtggctggggaggccatgtttatgtcgtgtcaccaaatcaagtgattgagcgcacattgaagggacgcatggactgagccatttttcttgcaagagaaattacatgtcatagcagtgttattggtgtctattaaatgaacagaattgtactttagtacatagtggagttaagagtcgttcaaaccattaatacatttgatgtcattgcacaagaagccacctttcactgaatcttttactgcatctctaatcaatttgcaagcaagtctttcaatggaccaagcttacaaataatcagatttcaatttcctaattttgaaatggtacattttgagggagcaaaatcttctgaawttttgtactcttatgtgagagactgatttctttgcttgttttaaattggcgatcctttcagaaagtagctatccagtcaataaagctagtatcaggtaaaatattgctcgtcaactgtttcacatytgcaaatgagaacywtcggtgctaaaacgttttgca

SEQ ID NO: 505 - DNA, 978 bp, Saccharum officinarum
ctttcggccggcgccggcggaaatcaacctgagtcgccgccttctccgttctcgccgtcgcctctcctgccgccgctcccgctgtccacatcagcgccaaccatgtcgatcttcgagtacaacgggagcgccgtggtggcgatggtggggaagaactgcttcgcgatcgccagcgaccgccgcctcggcgtgcagctgcagacgatcgccacggacttccagcgggtgttcaagatccacgacaagctctacatcgggctctcggggctcgccaccgacgcccagacgctgtatcagcggctggtgttcaggcacaagttgtaccagctgagggaggagagggacatgaagcccgagacctttgccagccttgtttcagccctcctctatgagaaaaggtttgggccatacttctgccaaccagttattgctggcctaggagacaacgatgagccatttatatgtacaatggactgcattggtgccaaggaactagcaaaagattttgtggtctctggtactgcttcagagtcactttatggtgcttgtgagtccatgtataagccaaacatggaacctgatgaactgttcgagacaatctcacaagcattgcaggcatctgttgatcgcgactgcctcagtggctggggcggttatgttcttattgtcacacccactgaagtgcaggagagagtgctgaagggaaggatggactgagtgctgccatgtagttattttaggagattgtttcttcattcggcctgccctgccctgtactacggcgtacagaattcagaaaacctgtgcactacgtttacttctcaaagaacattgattcagtagttgccttcgtctttctatgctgtttctgccccagcattttagaattgcatgacttgtggcacttcagttatggtaatcggcatatatgtttgaccagttaacagggacatccgtgccgcacgggttttgtcttgg

SEQ ID NO: 506 - DNA, 937 bp, Saccharum officinarum
caaaccgcagagtcgcacccgaactgaggtcggacacgcggctccggagcggcatcgctggaccttcttgctcaccaagaagcccaacccggcctccatcaaaagcccaccgccgtcgctagtcgctacttcccctccgatcctcgacgccgacgcatccactcgaaccctcctccgccgcagctttggctatgtcgatcttcgagtacaacgggtccgccgtggtggcgatggtggggaagaactgcttcgcgatcgccagcgaccggcgcctgggcgtgcagcttcagaccatcgcgaccgacttccagcgggtgttcaagatccacgacaagctctacatcggcctctccgggctcgccaccgacgcccagacgctgtaccagcggctggtgttcaggcacaagctgtatcagctgcgggaggagagggacatgaagcccgagaccttcgccagccttgtctctgcgctcctctacgagaagaggttcgggccatatttctgccagccagtcattgctggacttggagatgacgacgtaccatttatttgtaccatggactgcatcggtgcaaaggaactggccaaggattttgttgtttctgggacagcatcagaatctttgtatggtgcttgtgaatccatgtacaagccaaatatggaacctgatgaactcttcgagactatatcccaagctctaagttcatcagtagaccgtgactgccttagtgggtggggtggctatgttctgattgtgacaccgactgaagtgagggagcatgtgattaagaccaggatggactaaatcatggccactagagttcttagcttgtttccaatgcttagaccaatgttgtgtttggtatgcttagaccaatgcttagaccaattgtatcatcacagttggtatgagaaggaacgtttgctttctttagg

SEQ ID NO: 507 - DNA, 1001 bp, Saccharum officinarum
tcgctctcgccccccaaaaccagatcggcacgacgagagcagagagagggccccggagcggcgcggagcggagcaatggcggcgggctaccgggcggaggacgactacgactacctcttcaaggtggtcctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaggaacgatatcgtgctattactagtgcgtattaccgtggtgctgttggggcattacttgtatatgacgtcactcgtcactcaacgtttgagaatgttgagcgctggctgaaggagttgagggaccacacagatcccaatatagttgttatgctggttggcaacaaatctgatctccgccatcttgtagcagttcaaactgatgaaggaaaggctttcgcagagagggaatcgttgtatttcatggagacctctgcacttgagtccaccaacgttgagaatgcatttgcagaggtcttaacccagatctaccgcattgtgagtaagagagcagtcgaagcaggtgaagatgcagcatctgggcctggcaagggcgagaagatcaacataaaggatgatgtttcggcggtgaagaagggtggctgctgctctagctgagctgcactgctggtatttttttgggactygtgtgatgtagcttatgttatggcatttccagcaactgagaattggtagtggcattagcagcttctatgttacctagagagtttattgtcaaactgaaaaaaaaaactgaaggttagatcagtatagatctttctattattgtattgtgtatccaaggcatggtattgtttttgctgtgaatccactgcgaccatgttcaaacttatgaaatgttcgaaatagaaaggtgcttcatgcttacc

SEQ ID NO: 508 - DNA, 1009 bp, Helianthus annuus
cagcacccacaaaatctttcttctccacacgacaaccactccggcagttccttaaaccaaaaaccccctccttagcaaactccgaccaacaccaccgcttcgtctatatcttcagtttcacatattcaagcttttgtttgcgaaaaggaggtcaattttgagttcatcacagtcaacacaaccgtcagagaacccacaacacctcgttatgtcgatttttgagtacaatggaagtgccttggtggcgatggtaggtaagaattgctttgcaattgctagtgataggaggcttggtgttcagcttcaaactattgctaccgatttccaacgtattttcaagattcatgataagcttttcctcggtctatctggtcttggttccgatgctcagacacttcatcagcggcttgtgtttcgccacaagctgtatcagctgagggaagaaagagacatgaagcctgaaacttttgctagccttgtctctgctatgctgtatgagaaaaggtttggtccttacttctgccaacctgtgattgctggattgggagaggacgacaagccatttatttgcacaatggactcaattggagcaaaggagcttgcaaaagattttgtggtggctggtactgcatcagagtctctttatggtgcctgtgagtcgatgttcaagccagatatggatcatgaggagctgtttgaaaccatctcccaagcacttatatcatcagttgaccgtgattgtttaagtggttggggaggacatgtctacattgtcacaccgactgaagtgaccgaaagaatcttgaaagggagaatggattgatctacaaaaagttatttagccttggctttgggattgaaggggttaagcttcggcactttggtgtccggtagcttgttatttccgaaggtgtttttgtgcttttgacttggaaacttttatggtattgttctgtaccagtcagtcttcaacggatgttttatctaaaactctctttcttgggtcttc

SEQ ID NO: 509 - DNA, 910 bp, Helianthus annuus
ggatcacaggtaaccgattgtccaagctactaccctattcataaagcctctgaacaaacaaatcgaaccaaaaaactccgatctccgttcaacctcaccgatcgatcagatgtcgatttttgagtacaatggaagtgccttggtggcgatggtaggtaagaattgctttgcaattgctagtgataggaggcttggtgttcagcttcaaactattgctaccgatttccaacgtattttcaagattcatgataagcttttcctcggtctatctggtcttggttccgatgctcagacacttcatcagcggcttgtgtttcgccacaagctgtatcagctgagggaagaaagagacatgaagcctgaaacttttgctagccttgtctctgctatgctgtatgagaaaaggtttggtccttacttctgccaacctgtgattgctggattgggagaggacgacaagccatttatttgcacaatggactcaattggagcaaaggagcttgcaaaagattttgtggtggctggtactgcatcagagtctctttatggtgcctgtgagtcgatgttcaagccagatatggatcatgaggagctgtttgaaaccatctcccaagcacttatatcatcagttgaccgtgattgtttaagtggttggggaggacatgtctacattgtcacaccgactgaagtgaccgaaagaatcttgaaagggagaatggattgatctacaaaaagttatttagccttggctttgggattgaaggggttaagcttcggcactttggtgtccggtagcttgttatttccgaaggtgtttttgtgcttttgacttggaaacttttatggtattgttctgtaccagtcagtcttcaacggatgttttatctaaaactctctttcttgggtcttc

SEQ ID NO: 510 - DNA, 887 bp, Helianthus annuus
tcttcgtgcaaaagtcccatcaccttcatctctttctctctctaaacccccattttctctctctacaattctactgattaccgtctcgatcaaccgtctccagccatggctaacgctgcatctgggatggctgtgcatgatgaatgcaaactaaagtttttggaactgaaggcaaaaagaacattccgttatattatttttaagattgaggagaaacaaaaggaagtgatcgtggaaaaagttggcgagccaacccaaagccacgaagattttgctgcgtcactacctgctggtgaatgtcgatacgctgtctttgattatgactttgttactgcagagaattgccaaaaaagcaggatctttttcattgcatggtcacccgataccgcaaaggtgagaaacaaaatgatttacgcgagctccaaagaccgattcaagagggaacttgatggaatccaggtcgagcttcaagcaacggaccccactgagatggaccttgatgtattcaaaagccgggccaattaaaacaaaacggtgaaaattgatattatgatcaagagagatgttaatttgcctatggtatgtttctggtttgtgtttgaagtggtatttgcagtgattttggtacttttttttgaccctttttatggttttggttttggtcttggtctacctaagtagcaaattcagtgatctttggcaaatattttgttatgtgaaaaacttattacatggatttccattatattaccttttgatttgttctgtaacactatttaagtggttggaaaacattgatcattgctatataagaaaattatacatgacatcagcattttgaaaatggaccaagaacaattagtttggttgagtgctacaaaaatacc

SEQ ID NO: 511 - DNA, 868 bp, Helianthus annuus
actaccctattctaaagagcctctgaacaaacaaatcgaaccaaaagaagctccgatctccgttcaacctcaccgatcgatcagatgtcgatttttgagtacaatggaagtgccttggtggcgatggtaggtaagaattgctttgcaattgctagtgataggaggcttggtgttcagcttcaaactattgcgaccgattttcaacgtattttcaagattcatgataagcttttcctcggtctatccggtcttggttccgatgctcagacacttcatcagcggcttgtgtttcgccacaagctgtatcagctgagggaagaaagagacatgaagcctgaaacttttgctagccttgtctctgctatgctgtatgagaaaaggtttggtccttacttctgccaacctgtgattgctggattgggagaggacgacaagccatttatttgcacaatggactcaattggagcaaaggagcttgcaaaagattttgtggtggctggtactgcatcagagtctctttatggtgcctgtgagtcgatgttcaagcccgacatggatcatgaggagctgtttgaaaccatctcccaagcacttatatcatcaattgaccgtgattgcttaagtggttggggaggacatgtctacattgtcacaccgactgaagtgaccgaaagaatcttgaaagggagaatggattgatctacaaaaagttatttagccttggcttcgggattgaatttttttactttggtgtccggtagcttgttatttccgaaggtgtttttgtgcttttgacttggaaacttttatggtattgttctgtaacagtcggtcttcaacggatgttttatctaaaactctctttctt

SEQ ID NO: 512 - DNA, 527 bp, Thellungiella halophila
ggtaagagaaaagacgcacaccgaagaaaaacaaaagactccataatctcctgcttcttcgtctccgcaagatttttcttctgaaactaatttgattcagccatggctaatgcggcatcaggaatggcagtccacgacgactgcaagctgaagtttctggaactgaaagcgaaacgaacataccgtttcatcgtttacaagattgaggagcagcagaaacaagtgattgtagagaaagtcggcgagcctggtcaatcccatgatgactttgcagcaagtcttccagctgatgaatgccgatacgccattttcgattttgattttgtcactgcagagaactgtcaaaagagcaagattttcttcgtcgcatggtctccggacacagcaagagtgagaagcaagatgatctatgcgagttctaaggacaggttcaagagagaattagacggaattcaagtcgagcttcaagcaactgatccaactgagatggatcttgatgttttcaaaagccgagccaactgagaaag

SEQ ID NO: 513 - DNA, 867 bp, Nicotiana tobaccum
gtctctttttagcctcatacgtaaatattttgtcgaggaagagagagggaacggcaatggaggacgacgtggagatggcggccgccgataacagagcagccgtggaaatggatgagatgaagaagaggttgaaggagatggaggacgaatctgctgctctacttgaaatgcaagccaaagttgagaaagaaatgggttccgttcaagaccctgctgctgctgctgcaactcaagcgaacagggaagaagtggatggtcgatctgtctttgttggcaatgtggattattcatgcactccagaagaagtgcaacagcattttcaggcatgtggcacagttaacagagtaactatccggactaacaaatttgggcaaccgaaaggatatgcctatgttgagtttctcgaagcggaagctgttcaagaggctcttcttctgaatgaatctgaacttcatggccgccaaattaaggtatcagcaaagcggactaatgttcctggtatgaagcagtttcgtgcaaggcgtccaagcccgtatatgggatttcgcggccaaacacctttcatgcctgctccttatttttattctccttatggatatgggaaggttcctagggctagggcacccatgcgttatagcccctacttttgagatgttgcctttctcgagacatacgtaccgctggagtggaatagataaacatctcattaaatgtagtagtgacgcaccacctgtatggctaattgcctttgcagatcctatttatcatgaaatcatgctgttagaggcctttgtggcagagattgtaatcatcaattctattattgtgtcctcgagagctctactacatagaggttttaaattttta

SEQ ID NO: 514 - DNA, 828 bp, Nicotiana tobaccum
ctccacaggttctcagaccaaaaacctttccgcaacatagttcgtttcgtcgttctcttcagtcccagaatgtcgatctttgagtacaatggaagtgccctagtggcaatggtggggaagaactgctttgcaattgcaagtgaccggagacttggtgtgcagctgcagacaatcgccactgattttcaaagaatattcagaatccacgataaggttttcattggcctttcagggctgggtaccgatgtccaaacactgtatcaacggctagtgttccgtcacaagttatatcaacttagagaagagagggacatgaagcctgagacttttgccagccttgtatctgctcttctttatgagaaaaggtttggtccatacttttgccaacctgtaattgctggattaggagatgatgacaagccatttatttgcacaatggactctattggagcaaaggagcttgccaaagattttgtcgttgctggtactgcctcagaatctctgtatggtgcatgcgaggccatgttcaagcctgacatgggaccagaagaattgtttgagaccatctcgcaggccctcatagcatcagtggaccgtgattgtttaagtggttggggaggacatgtttatgttgttacaccaactgaagtgacagagaagatcttgaagggaaggatggactagacaaactttttcattggtgtcctaaactttgttcattgcattcccaggaaaatgttcttttgtgatgaatgcccctatgcttatgtttgatattatgtactctttttgtaccattttatattgcattctttcttagcatgttcc

SEQ ID NO: 515 - DNA, 895 bp, Nicotiana tobaccum
ctccacaggttctcagaccaaaaacctttccgcaacatagttcgtttcgtcgttctcttcagtcccagaatgtcgatctttgagtacaatggaagtgccctagtggcaatggtggggaagaactgctttgcaattgcaagtgaccggagacttggtgtgcagctgcagacaatcgccactgattttcaaagaatattcagaatccacgataaggttttcattggcctttcagggctgggtaccgatgtccaaacactgtatcaacggctagtgttccgtcacaagttatatcaacttagagaagagagggacatgaagcctgagacttttgccagccttgtatctgctcttctttatgagaaaaggtttggtccatacttttgccaacctgtaattgctggattaggagatgatgacaagccatttatttgcacaatggactctattggagcaaaggagcttgccaaagattttgtcgttgctggtactgcctcagaatctctgtatggtgcatgcgaggccatgttcaagcctgacatgggaccagaagaattgtttgagaccatctcgcaggccctcatagcatcagtggaccgtgattgtttaagtggttggggaggacatgtttatgttgttacaccaactgaagtgacagagaagatcttgaagggaaggatggactagacaaactttttcgtttagatcctcaatcctgtacttgttcattgcattccctggtagacatttatgccgccttgtttatgtttgatgttgtgtattcaagttattgacatttggctgaacaattagttcaagttattagttagtatctagtatgttaagttttatgtgatacgaatcctttatttacccccatatacgtgtcaaatgagtg

SEQ ID NO: 516 - DNA, 818 bp, Nicotiana tobaccum
ttcgtatctggtctcatcatcgacaagaaaagacaactttatcggagccctaaattttctcctctcttcatccgctctctctccttcaaaatcatggctaacgcagcatcagggatggctgtgcatgatgattgcaagctgaagtttttagagttgaaggcaaaaagaactcaccggttcatcatctataagattgaagagaagcaaaagcaagttgttgtggaaaagcttggtgaaccaactgaaagctatgaggatttcactgcaggcctccctgctgatgagtgtcgatatgctgtctacgactttgatttcacgactgaagaaaacgtccagaagagcagaatattcttcattgcttggtcacctgacacggcaagagtgagaagcaagatgatttatgcaagctccaaagacaggttcaagagagagcttgacggtttccaggtagagctgcaagcaactgatcctacagagatggggcttgatgttttcagaagccgagttggtggaattgaatgttgagtgcacgagtttcttgcttatgctaagtgattatagtttgtggggaagtagaacgtggttagttatactattggcttgtcgttcgcgttcatcgtactcttttaagtctcttcttctcagagaacttccaatactctttaatatgttatattgttactcatgaagtcaaggagctactttgttattttgagttttagttcatcttgctccttttaacttctcagagaacttcagtaatcttttatatatgtttgttactcatgaaatcaaggaacatcttcttattttgtgcg

SEQ ID NO: 517 - DNA, 866 bp, Nicotiana tobaccum
gctcctttagctttacattcacagaacaccgcgttcttgagccttgagctttagcccttcaatctcttccaatttctcccaattttcaacttccaatacaatcaaaatggctaatgcagcgtctgggatggctgtgcacgatgactgcaagttaaggttcttggagctgaaagccaaaaggactcaccgctttattgtttttaagatagaggagaaacaaaagcaggttgtggttgaaaaggttggtgagccaaccgaaagctacgaggatttcgctgcaagtcttcctgataatgaatgtagatatgctgtctacgattttgactttgtcactgcagagaattgccagaaaagcaggatctttttcattgcatggtcccctgacacgtcgagggtgagaagtaagatgatctatgccagttcaaaggacagattcaagagagagctcgacggaattcaggttgagttgcaagcaactgatccaactgaaatgggacttgatgttattaagagccgcgccaactagatatcgatggataggtatcagatggaccttataagtgagaaaactcctaatgcaatcatctttacttattggaaatatttatagtgtgacagatacttggccaagtgctacagttatatgtactatttaatgaacaagttttatggtgtttggtatatgatgtaatttgttacttcagaatttattcttctgagtgtttcactggtagcatgatttacaagctaattgtatccattttctgagggataggatacagttagattgcttttcaatatctgatttgacactttgccctatgattcttgttttggaatggatacaagcaagcttattgctgttc

SEQ ID NO: 518 - DNA, 759 bp, Nicotiana tobaccum
ttcgtatccggtctcattatcgacaagaaaagaccaactttatcggagccctagattttctcctctcttcaatccgatctctctccttcaaaatcatggctaacgcagcatctgggatggctgtgcatgacgattgcaagctgaagtttttggagttgaaggcaaaaagaactcaccggttcatcatctataagattgaagagaagcaaaagcaggttgttgtggaaaagcttggtgaaccaactgaaagctatgaggatttcaccgcaggcctccctgctgatgagtgtcgatatgctgtctatgactttgatttcactaccgaagaaaacgtccagaagagcagaatattcttcattgcgtggtctcctgacactgcaagagtgagaagcaagatgatttatgcaagctccaaagacaggttcaagagagagcttgacggtttccaggtagagctgcaagcaactgatcctacagagatggggcttgatgttttcagaagccgagttggtggaattgaatgttgagcgcatgagtttcttgcttatgctaaatgattatagtttgtgggtaagtagaacgtggtagttatagttatattattggcttggcattcgcgttcatcttactcttttaagtctcttcttctcagagaactttcaatactctttaatatgttatattgttgcccatgaagtcaagttaactcttcagagaacttcaattatatcttttatatatgctttattgttactcgtc

SEQ ID NO: 519 - DNA, 928 bp, Nicotiana tobaccum
ttagtcgaagggtagctgctgcagccgcttctgctgcagaagcagcagctgcggctggtgaaagcagtttcagatctttcatggttgctgtgcaacgttgtgggagcagtgtggctattgtgcagcaatatttcgcaaactctatatctcggcttttactacctgtggatggtgcgcatgctgcttcctgtgaagaaatggctacagctatgtcaagtgctgagggtgctgcttataaggggcttcagcagtgcattgaaactgttatggcagaggtggaacgcatactttcaactgaacaaaaagccacagattatcgatcacctgatgacggcattgcccctgaccatcggccaacacaagcttgttcaaaagttgtcgcgtacctttcgcgggtgcttgaatcggcattcacagcactggaagggcttaacaaacaagctttcctggctgaattggggaatcgtttacacaaaggcttgcttaatcattggcaaaaattcacttttaatgcaagtggaggactgcgtttgaagcgtgatataacagagtatggggagtttgttcgtagtttcaatgccccttctgttgatgagaaatttgaacagctgggcatcatggcaaatgtgtttattgttgctccagaaagtctttcaacactgtttgagggaaccccgagcattaggaaagatgcacaaaggttcattcagcttcgggaggattacaagagtgcaaagcttgcagcgagactcagctccttatggcctagctctagttagaaccaaaatcacatgctaattagagttaaaacttttattctagtggtgagctggacagagtgcagttgtattgtgagagcttttccaccacctcatgctggctgtctattacccgaactcagtgataaagaaacatcgttgatccagag

SEQ ID NO: 520 - DNA, 993 bp, Nicotiana tobaccum
ggggaacaagtcttttctagtctccattttctctctctacatatacacattctctttctacatatatatataggagtacaaaaatatctgcactgttccagattttctctcttcagatcctttcaaatttctccgatcatctccagtagccatggctaatgcggcatcaggcatggctgtgcatgacgattgcaaactgaagtttctggaattgaaagctaagaggacttatcgcttcatagtattcaaaattgaggagaagcaaaagcaggtcatcgtggaaaagcttggtgaacctgctgagagttatgaggactttgctgctagtctacctgcagatgagtgtcgatatacagtgtttgattttgactttgtgacagaggagggttgccagaagagcaagattttctttattgcgtggtcccctgatactgcgaaggttagaagcaaaatgatctatgctagttccaaggatagattcaagagggaactggatggaattcaggttgagctgcaggcaactgacccaactgagatggggctggatgttttcaaaagccgcaccacttaaataaaatcctctagtacagcaacggatgtgctctttgctttgctcaagagaattgttaatagtccgtcgggacgagagggaaatatgatgtttgttatcaagtttaacattgaagtcgtctttagaaaaatcatgtggttttgttcttattttcgtgtttgtcgtgtgaaacttgttctttggtttggagctggtaacaattaacaatccttgggttgttctttggtttgtatgtttctgttgatagctgacctgattgcaacttctgtatctttgatttatggagatgctgaccggcagccactgtgatcatttatagtcgttcatcttcacatttgttttgttttgtcttgttgattttgatgctggcgccttgagtaacttttccaggtcttgaggcttactggaaatatcttaaattg

SEQ ID NO: 521 - DNA, 926 bp, Nicotiana tobaccum
ggtgggtggtctccaccgaataccaagggttgaaaattcggaaaattctgggacaatttccccttttttatatctctcaagtcttctctagtctcaaccctctctctttacacaaaaaagaaaaaaacagaaaaatatcttctgtgagatcctttcgatcatctcgattcaccatggctaactctgcatcgggcatggctgtgcacgacgattgcaaactgaaatttttggagttaaaaactaaaaggacttatcgcttcattgtattcaagattgaggaaaagcaaaagcaagtcattgtggaaaagcttggtgagccggctgaaagttatgaggacttctgtacacacctgcctgcagatgagtgtcgttacgctgtttatgattttgactttctgacaaaggagagtgttccaaagagcaggattttctttattgcatggtctcctgatacctctaaggttagaagcaaaatgatctatgctagttccaaggatagatttaagagggaattggatgggattcagattgagctgcaagcaactgatccaactgagatgggtttggatgtcttcaaaagccgtgccaactaaataaagttytctagtacagcattggatgttctctttacttttgttgaagagaaatgttaatatttgttgggrcagggtcctggctaagatatgatattkgtctgttgtcaaattctattttaaaaggcttgtcatcctgtagacattatgtggttttggtcttattttgtggtgtttgcgcgtggaacttrtgtcatgrgtagcttttggggctggtacgaaktaacaattgttatcagattgttccttctttcattttgtgtgtttcttcttatcctgttgcaccttctgtaatccgtttatgtgttatgatgctggctgggtgctgctgac

SEQ ID NO: 522 - DNA, 802 bp, Nicotiana tobaccum
cattcacagaacaccgcgttcttgagccttgagctttagcccttcaatctcttccaatttcccccaattttcaacttccaatacaatcaaaatggctaatgcagcgtctggaatggctgtgcacgatgactgcaagttaaggttcttggagctgaaagccaaaaggactcaccgctttatcgtttttaagatagaagagaaacaaaagcaggttgtggttgaaaaggttggtgagccaaccgaaagctatgaggatttcgctgcaagtcttcctgataatgaatgtagatatgctgtctacgattttgactttgtcactgccgagaattgccagaaaagcaggatctttttcattgcatggtcccctgacacgtcgagggtgagaagcaagatgatctacgccagttcaaaggacagattcaagagagagctcgacggaattcaggtcgagttgcaagcaaccgacccaactgaaatgggacttgatgttattaagagccgcgccaactagatatcgatggataggtatcagatggaccttataagtgagaaaactcctaatgcaatcatctttacttattggaaatatttatagtgtgacagatacttggcaagagatgattgatattggttgccaagtgctacagttatatgtactatttaatgaacaagttttatgatgtttggtatatgatgtaatttgttacttgagaatttattcttctgagtgtttcactggtagcatgatttacaagctaatatgtatccatttctaagggataggatacagttagattgcttt

SEQ ID NO: 523 - DNA, 791 bp, Solanum lycopersicum
caagaacccctcttcttcgtatctggtctcattttcccccaaataccaattttatcggagccctaaattttctccatttttctcatctttttcaaatctgttttctcgcctcaatcatggctaacgcagcatctgggatggctgtgcatgatgattgcaagctgaagtttttagagttgaaggcaaaaagaacttaccgtttcatcatttataagattgaagagaagcaaaagcaggttattgtggaaaagcttggcgaaccaactgaaagctatgaggatttcgctgcaggcctccctgctgatgagtgtcgatacgctgtctatgactttgatttcatgacagaagaaaactgccagaagagcagaatattcttcattgcttggtcacctgacacagcaagggtgagaagcaagatgatttatgcaagctccaaagacaggttcaagagagagcttgatggattccaggtagagctgcaagcaactgatcctacagagatggggcttgatgttttcagaagccgagctggtggaattgaatgttgagtgtgtgagtgtctttgtttatgttaagtgcttatagtttgtggggaagtagaacttggttagttatactactggcttgtcgttcccaatcaccttactctctaaagtctcttcttctcagagaacttcaatactttttaatccatgttatattgttactcatgaaatcaaggagttatcttcttacattgagcatcattgttttcttttcattgatcatactcttttaagtctcatctattc

SEQ ID NO: 524 - DNA, 890 bp, Solanum lycopersicum
caaggagaagagctcctctagtctttaagattcacataaaaacatctctttcttattgagccttgaagcccttcttgaaatctctttgaatttttcaaatacaatcaaaatggctaatgcagcgtccgggatggctgtgcatgatgactgcaagttaaggttcttggagctgaaagcaaaaagaacgcaccgctttattgttttcaagatagaggagaaacaaaagcaggttgtggttgaaaaggttggtgagccagcccaaggttacgaggatttcactgcgtgtcttcctgataatgaatgtcgatatgctgtctacgattttgatttcgtcactgcagagaattgccagaaaagcaggatctttttcattgcatggtcccctgacacatcaagggtgagaagcaagatgatctatgccagtacaaaggaaagattcaagagagagcttgatggaattcaggttgagttgcaagcaaccgacccaaccgaaatgggacttgatgttattaagagccgcgccaactagatatcgactgataggtatcagatggaccttataagaagtgaaaactcctaatgcaatcatcttttttacttttaaggaaatatttacagtgtgacagatacttggtatattgattgccaagtgctctacagtatatgtactttttaatgaacaagttctatggtgtttgatatatgatgtaatttgttacctttttttgttccaagttttcaactagtagtttgattctataaactaatatgtatccatttctgagggataaggtacattttagattgttttcctaaatcttcttttgacacttcactttgtgattcttgttttggaatggttacaaacaaagttaattgctgttttaatt

SEQ ID NO: 525 - DNA, 1079 bp, Solanum lycopersicum
atcggccgaattgcttgcacaattgaagtgttcttcaagccatcaaaaactcagtctctcttcattagcaaaagcactttgcgaaaaacttcgattcgtttctctaaaatcactctccaatgtcgatctttgagtataatggaagtgctttggttgcgatggttgggaaaaactgtttcgctattgcgagtgataggcgttttggagtacagctgcagacaatcgctattgatttccagaggatttataaaatacatgacaagctttttattggactttctggcttggctactgatactcaaacactgcatcaacgcctcatgttccgtcacaagctatatgagcttagagaagatagggatatgaagcccgagacctttgccagccttgtatctgctatgctttatgagaaaaggtttggtccatacttgtgccaacctgtaattgctggattaggagaagatgacaagccttttatttgcacaatggactctattggagcaaaggagctcgcaaaagattttgttgtttctggcactgcatctgaatcactttacggtgcttgtgaggccatgtacaagcccgacatgggaccggaagaattgtttgagaccatctctcaggcactgttgtcatctgtagaccgtgactgtttaagtggttggggaggacatgtttatgttgtgacaccaactgaagtgacagagaggatcttgaagggaaggatggactgaacacttgtggggtgctatacttgttcactattgcatttcactgggatgacatttcacttgttttgatgaatactcaacatttcatatttgatgttatcgcatcgacttctctccaagattgttatttaatagattcagttgtctgtcactaatggatgttaacattctagttagtttacaatcctctatttgagcatcccaacgaatttctgctgccatcacacactagacaaattatacagaagatgaatcaatttctttggggggactccttgtggaattgcaatattgtaggaaagataaatgttggaactgatattattatacaatctttaatttcctctg

SEQ ID NO: 526 - DNA, 1758 bp, Solanum lycopersicum
tccaaagctacttgagaaactctaactgaaaccgtctcttgttagtccacctgccatggaagaaggaggacttatattatatctcagattgctagcggtggcatatgagaagacacaagagcttgctagagacttgcgtggtgtaaggggtggcgacctggatgttgaaggtttaacggaatccctttttctaccccacaaagctatatacattgagtacgagcaggcctctcttagacaactctacaaagctaagatggaggagctacgtgctgaaggccagcaatcctccgagtcatctgggacaattggacgctcaaaaggtgcttcaatggcatcctctcaccagcaaatttctgttacygtggtgacagagttcgttcgytggaatgaagaagcagtatccagatgcactttgttttcatcacagcctgctgcaattgctgctaatgtaagggctgtttttacatgccttctggaccaagtgagcatatacataactgaaggtcttgaaagagccagagacagtctcactgaggctgctgctttaagggaaagatttgtacttcctagtgtaagtcgaagggttgctgctgcagctgcttcygcggcagaagcagcagctgctgctggtgaaagcagtttcagatctttcatggtttctgtgcaacgctgtgggagcagtgtggctattgtgcagcaatattttgcaaactctatatctcgacttttactgcctgtggatggtgcgcatgctgcttcttgtgaagaaatggctacagctatgtcaagtgcagagggtgctgcttataaggggcttcagcagtgtattgaaactgttatggcagaggtggaacgtgtactgtcaactgaacaaaaagtcgcagattatcgatcacctgatgacagcattgtcccagaccatcggccaacacaagcttgttcaaaagttgtcgcatacctttcaagggtgcttgaatcggcattcacagcgctggaagggcttaacaaacaagcctttttgactgaattggggaatcgtttacacaaaggcttgcttaatcattggcaaaagttcaccttcaatgcaagtggaggattgcgtttgaagcgtgatataacagagtatggggagtttgttcgtagtttcaatgcaccttcagttgatgagaaatttgaacagttgggcatcatggcaaacgtgtttattgttgcacctgaaagtctatcaacactctttgagggaaccccgagcattaggaaagatgcacagaggttcattcagcttcgggaggactacaagagtgcaaaaattgcagcgagactcagctccttatggcctagctctagttagaacaaaagttaatgagcttttacaatagtggtgagctggatagagctatacagttgttcggtgagggctttccacctcctatatttgtcgtcttttacctgagctcgaagatagagaaatgttgctaattcagagtaattcatccttgaaagttcatatgcaacccctagccccttctgtgtaatcatcatttattgttttcttcacgatctgctcgtgtatgttgtggaactaggtatcgaacatgcgtatgtttttgctaattgtgactagtttgtttatatgctargtatgcatttgtattgttaaaagtagatgagacgaatgtaccagttttgttgttatagattctgattgtcctatactttatagaagttgttgcagtaaaggttatcttctttact

SEQ ID NO: 527 - DNA, 739 bp, Solanum lycopersicum
cctcaccgttctaaattcacagaaaccccgttattcagctccacaaaatcctcctttttaacttcttatttccttactactttgatctctctgaattttcgttcttcttcaaacttaatactctctctctgtacaatcaatatggctaacgcagcatctgggatggcagtgcatgatgactgcaaattaacgttcttggagctgaaaacaaaaagaactcaccgatttattgtttttaagatagaagagaagcaaaagcaagttgtggttgaaaaagttggtgagccaactcaaagctatgaggactttgctgaaagtcttcctgctgatgaatgcagatatgctgtctacgattttgacttcgtaactgaggaaaattgccaaaaaagcaggatctttttcatcgcatggtcccctgacacagcaagagtgagaagcaagatgatctatgccagttcaaaggacagattcaagagagagcttgacggaattcagattgagttgcaggctmctgatccaactgaaatggaacttgatgtaattaaaagtcgtgcaaactaggtatggatgattagataccagatagacctgtaaaagggagaatcttgatgcaatcatcttatttaaactgttcatagcwtgtgggacaaaaactggctatatcagtaccaagcgttacattttgattcttgaacgagctttatggtgggtggtctaatataagatgtgtttaatttga

SEQ ID NO: 528 - DNA, 1060 bp, Solanum lycopersicum
tctcccccatttccctcttcatctgaagagtcaaaaagctgaaaaaaagcaaacaaaacacaaaaaagaaagaaaaaaaaaagggtaagaaatcgaaaggaagatttgtttactaagggaaaacaatagttttgttcaatttttttctcaatttgaagttgttgagagtaatggctgggtacagagctgaagatgactatgattacctattcaaggtggtactaattggtgattcaggtgttggcaaatccaatttgctttcaagattcactagaaatgagtttagtctagagtctaagtctacaattggtgttgagtttgctactaaaagcttaactgttgatagtaaagtcatcaaggctcaaatttgggacactgctggtcaagaaaggtaccgtgccatcaccagcgcttactacagaggtgccgtgggtgctctgcttgtgtatgatgtcactcgacattcaacatttgaaaatgttgagaggtggcttaaggagttgagagatcatacagatcccaacatcgttgtcatgcttgtcggaaacaaatctgatctacgacatctggttgcagtgtcaactgaggacgggaagtcttttgcggagaaggaatccctctactacatggaaacttctgccctcgaatctacaaatgttgagaatgcatttgctgaagttctcactcaaatctaccacgtcgtgagtagaaaagccatggaaaatggtgagaatggaaacggaaacgtgccttccaaaggagaaaagattgatataggtaaagaagtatctgatgtcaagaaagctggttgctgttcatcctaagggctatataatctgtgctctgctgtatcctgttctaggtgcaccgtaccggtagtgtaaaattgtccagactacctttgacacgatcctatttgatactacctgttacattggtttttgttttggttggtagtaaagaatatcaatgttagagaaccttttttctaatggaaccaaaccctttgtgtagacctgttatggcttaactattgaatcattcttttctctccttttcc

SEQ ID NO: 529 - DNA, 1015 bp, Triticum aestivum
ccacgcgtccgcgctccgagactcttgactgactactgggccactgcgcgagacccaattacagaggactcgccgcttttctttccgtcgccggatacacaaccgaagccgccgcgctccgccgcctcctctcgctccgcctccgccgtctgttgcatccctgccagccatgtcgatcttcgagtacaacgggagcgccgtggtggcgatggtggggaagaactgcttcgcgatcgccagcgaccggcgcctgggcgtgcagctgcagaccgtcgccaccgacttccagagggtgttcaagatccacggcaagctgtacatcggcctctccggcctcgccaccgacgcccagacgctgtaccagcggctggtgtttaagcataaactgtaccagcttcgggaggagagggacatgaagcctgagaccttcgccagcctcgtctccgccctcctctacgagaaaaggtttgggccatacttctgccaaccgatcattgccgggctaggtgaaaaagatcagccatttatatgtaccatggactgcattggtgccaaggaactggcaaaagattttgtggtttctggtactgcttcagaatcattatatggtgcttgtgagtccatgtacaaaccagacatggaacctgaagaactatttgagacaatctcgcaagcattgctgtcttctgttgatcgcgattgcctgagtggttggggaggttatgttcttattgtaacgcccactgaagttcaggagagagtgctaaagggaagaatggactgatttcgcaacacctgtagtcctagatcacctaggagattgttccttcatattcgacctgaaacctgtgtgatctactctttatgtgctcaagcacttctgtgttctaccctacaacttggattttaacatgccactgaaatctgaaattgaaatcatgtgtgcctgtgcactttgtttcagaattacaacctctagtctgggcaggcttttgtatggcctgttgacactgga

SEQ ID NO: 530 - DNA, 942 bp, Triticum aestivum
ccccgaccagcagcggcggcgaccccctcccctcctcctccttcccccaatcgaactcggcggcccccgttccggcgactccggccatgtcgatcttcgagtacaacggctccgcggtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgcgacatgaagcccgagaccttcgccagcctcgtctcctccatgctctacgagaagagatttgggccgtatttctgccagccaattattgctggacttggacaggatgacgagccatttatttgtaccatggactgcattggtgcaaaggaacttgctaaggattttgttgtctcagggacagcatcagaatctctgtatggtgcttgtgaatccatgtacaaaccgaacatggaacccgaggaactcttcgagaccatatcacaagccctgttgtcgtcagttgatcgcgattgcctcagtgggtggggaggctatgttctaattgtgacaccgaccgaagttcaagagcgaattctcaagggcaggatggactagattatgcatggcctagaattcgtcagccgctttccgatgcttctacgcatgctgtttcgacatccctgttgtgccctggttccgaagtaaccttgtactgtcaaactgatgatgttatatttgcccgtagaaagaacatttgttgtcttcttatttctgctttctatcaatggtgagacatctctgtcacgtgctccgtcgccccttgacggtgaaacatatggaattgtcattttctcta

SEQ ID NO: 531 - DNA, 1051 bp, Triticum aestivum
  misc_feature (29)..(29): n is a, c, g, or t
cttgactgactactgggccctgcgcgagnacccaattacagaggactcgccgcttttcttttcgtcgccggatacacaaccgaagccgccgcgctccgccgcctcctctcgcctctcctccgccgtcggttgcatccctgccggccatgtcgatcttcgagtacaacgggagcgccgtggtggcgatggtggggaagaactgcttcgcgatcgccagcgaccggcgcctgggcgtgcagctgcagaccgtcgccaccgacttccagagggtgttcaagatccacggcaagctgtacatcggcctctccggcctcgccacggacgtccagacgctgtaccagcggctggcgtttaagcacaaactgtaccagcttcgggaggagagggacatgaagcctgagaccttcgccagccttgtctccgccctcctctacgagaaaaggtttgggccatacttctgccaaccaattattgctgggctaggtgaaaaggatcagccatttatatgtaccatggactgcattggtgccaaggaactggcaaaagattttgtggtttctggtactgcttcggaatcactatatggtgcttgtgagtccatgtacaaaccagacatggaacccgaagaactatttgagaccatctcacaagcattgctgtcttctgttgatcgcgattgcttaagtggttggggaggttatgttcttattgtaacgcccactgaagttcaggagagagtgcttaaggggagaatggactgatttcgcaacacctgcagtcctagttcacatctgagattgttcaaccaaaaacccgtgtgatctactgtttctgtgctcaagcacttctttgttcgacccgacaacttggattttaacatgccagtgaaatctgaaattgaaatcatgtgtgcctgtgcacttcgttccagaattacagcctccagtctgagcaggcttttgttttgcctgttgaaactggaggcaactattgcacatgacatgtctctgatatagtagttcggcttgtttggttcgtgtactatgcttgt

SEQ ID NO: 532 - DNA, 1018 bp, Triticum aestivum
cctcccccaccttccccttcccccctcgctctcctccttcgccaccccccacaaccagatcgccgacgcgacgggagcaatggcggcggggtaccgggcggaggacgactacgactacctcttcaaggtcgtcctcatcggcgactccggcgtcggcaagtccaacctgctctcccgcttcacccgcaacgagttcagcctcgagtccaagtccaccatcggggtcgagttcgccacccgctccctccaggtcgacggcaaggtcgtcaaggcccagatttgggacaccgctggccaggaacgataccgtgctattactagcgcatactaccgtggtgctgtaggagcgttgctcgtctacgacgtcactcggcacgcaaccttcgagaatgcagagcgctggctgaaggaattgagggaccatacagatccgaacatagttgtcatgcttgttggcaacaagtccgatctccgccatctcgtggcagtcccaaccgacgaagggaagtcgtttgcagagagggagtcactctatttcatggagacctctgcgctcgagtcgaccaatgtggaggacgcgtttgcggaggtcttgaaacagatttaccgcatcgtgagcaagagggcggtcgaggcaggcgaagagtcggccgccggccctggcaagggtgagaagatcaacatgaaggacgatgtctcggcggtgaagaagggtgggtgctgctctagctgaggcgccatgatgcattctttttgctgagcttttgtgatgtggcatttccagcgaccgggaattattagtagcagtagtagcaagtattattatttatgaatgttacctagagaagttgaagtttgttgctgaaccgggaagtttgtctagatgagggtgagaccttccttcatattgttgtatggtctttgaggcaatcggcatggtggagtattgtttttcaggtcattccgttgcaaccatgcttaacttttcaacttgattgaaatttgcttcacgtttgcc

SEQ ID NO: 533 - DNA, 657 bp, Triticum aestivum
cacgaggcaatgatgcaactgaaggagttgttcaatgtaaaccatttcattgtgagccaaactaatccacacatctctccactcctcagaatgaaggagatcgtcagagcttatggaggccgctttgcaggaaagctcgctcgtcttgctgagatggaggtgaagtatcgatgtaaccaagttctggaaattggcctcccactaggaggacttgcaaagttgtttgctcaggattgggagggtgatgtcaccatggttatgccagcaacagtagctcagtacttgaagattatacaaaacccgacatatccagaactccaaatggctgccaaccakkgtckcaggtgcacatgggagaagatctctgcgatcagagcaaactgtgcaattgaacttgcattggatgaatccatagcagccctcaaccacaaacgaaggctaagaagaagcattgaaagggcagcagcttcttcccagggatataccgacagtgttcgactcaaaacaccaaggagggtgccatcatggagctgcatcagccgagagaattcgtcaggatctctctcggaagatcacttcgcggccgccatctcatccaatcaccaaggtactattcgagtggatggtgcaccgcacacgtctcatcatgttcgtcag

SEQ ID NO: 534 - DNA, 1004 bp, Triticum aestivum
cacttcccccgatcagcagcagcggcgaccccctcccctcctccttcccccaatcgaactcggcggcccccgttccggcgactccggccatgtcgatcttcgagtacaacggctccgcggtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgagacatgaagccagagaccttcgccagcctcgtctcctccatgctctacgagaagagatttgggccatacttctgccagccgattattgctggacttggacaggacgacgagccatttatttgtaccatggactgcattggtgcaaaggaacttgctaaggattttgttgtctcagggacagcttcagagtctctatatggtgcttgtgaatccatgtacaaaccaaacatggaacctgaggaactcttcgagaccatatcacaagctctgttgtcgtcagttgaccgtgactgcctcagtgggtggggaggctatgttctgattgtgacaccgaccgaagttcaagagcgagtgctcaagggcaggatggactagattatgcatggcctagagttcgtcagctgctttccgatgcctgtacgattgctgtttgaatatccctgttgtgccctggttccgaagcgaccttgtactgtgaaaatcgatgatatttgtccgtagaaggaacatttgttttcttttatttatactgtctatgcttttatattatatcaatggcgagacatctctgtcgtgtcgtccgtcagaccctacggcgaaacacatgggatcgtcattttctctaaggttagggtactacgttcatatgcatgcaccgagtgctttgtgcgatga

SEQ ID NO: 535 - DNA, 984 bp, Triticum aestivum
aaccgaagccgccgcgctccgccgcctcctctcgctccgcctccgcctccgccgtctgttgcatccctgccggccatgtcgatcttcgagtacaacgggagcgccgtggtggcgatggtggggaagaactgcttcgcgatcgccagcgaccggcgcctgggcgtgcagctgcagaccgtcgccaccgacttccagagggtgttcaagatccacggcaagctgtacatcggcctctccggcctcgccacggacgcccagacgctgtaccagcggctggtgtttaagcacaaactgtaccagcttcgggaggagagggacatgaagcccgagaccttcgccagcctcgtctccgccctcctttacgagaaaaggtttgggccatacttctgccaaccaattattgccgggctaggtgaaaaggatcagccatttatatgtaccatggactgcattggtgctaaggaactggcaaaagattttgtggtttctggtactgcttcggaatcactatatggtgcttgtgagtccatgtacaaaccagacatggaacccgaagaactatttgagaccatctcacaagcattgctgtcttctgttgatcgtgattgcttgagtggttggggaggttatgttcttattgtaacgcccactgaagttcaggagagagtgcttaaggggagaatggactgatttcgcaacacctacagtcctagttcacacatgagattgttcaacctaaaacccgtgtgatctactctttctgtctgtgctcaagcacttctttgttcgatgctacaacttggaatttaacatgccactgaaatctgaaattgagatcatgtgtgcctgtgcactttgttccagaattgcagcctccagtctgagcaggcttttgttttgcctgttgaaactggaggcaactattgcacatgacatgtctctgatatagtagttcggcttgtttggttcgtgtactatgcttgt

SEQ ID NO: 536 - protein, 139 aa, Malus x domestica
MANAASGMAVHDDCKLKFLELKAKRTYRSIVFKIEEKQKQVVVEHVGEPAETYEQFTEKLPADECRYAIFDFDFLTPEGVQKSRIFFIAWSPDTSRVRSKMIYASSKDRFKRELDGIQVELQATDPTEIGLDVIKSRAS

SEQ ID NO: 537 - protein, 158 aa, Malus x domestica
MANAASGMAVHDDCKLKFLELKAKRTYRSIVFKIEEKQKQVVVEHVGEPAETYEQFTEKLPADECRYAIFDFDFLTPEGVQKSRIFFIAWSPDTSRVRSKMIYASSKDRFKRELDGIQVELQATDPTEIGLEVIWSRAIKIDIEIVIYLRRTYVNRQL

SEQ ID NO: 538 - protein, 216 aa, Malus x domestica
MAGYRAEDDYDYLFKLVLIGDSGVGKSNLLSRFTRNEFSLESKSTIGVEFATRSLDVDGKVIKAQIWDTAGQERYRAITSAYYRGAVGALLVYDVTRNSTFESVERWLKELRDHTDPNIVVMLVGNKSDLRHLVAVSTEDGKSFAERESLYFMETSALEATNVDNAFSEVLTQIFRIVSRKAMEAGDGAASTVPQGEKIDVSKDVSAVKKAGCCSS

SEQ ID NO: 539 - protein, 204 aa, Malus x domestica
  misc_feature (186)..(186): Xaa can be any naturally occurring amino acid
  misc_feature (202)..(202): Xaa can be any naturally occurring amino acid
MSIFEYNGSALVAMVGKNCFAIASDRRLGVQLQTVATDFKRISQVHDRLFIGLSGLATDAQTLYQRLMFRHKLYQLREERDMKPETFASLVSAILYEKRFGPYFTQPVIAGLGDEDKPFICTMDSIGAKELAKDFVVAGTASESLYGACEAMFKPDMEPEELFETVSQALLSSVDRDCLSGWGGHXFVVTPTEVQEKILKGXMD

SEQ ID NO: 540 - protein, 168 aa, Malus x domestica
PSRHRRRDPLSLYLLLLLRRHQRTKQAAKMANAASGMAVHDDCKLKFLELKAKRTYRSIVFKIEEKQKQVVVEHVGEPAETYEQFTEKLPADECRYAIFDFDFLTPEGVQKSRIFFIAWSPDTSRVRSKMIYASSKDRFKRELDGIQVELQATDPTEIGLDVIKSRAS

SEQ ID NO: 541 - protein, 235 aa, Malus x domestica
ETNRPIIYSCVESIRTNETIYLSQSSVKAIGFRFGLLKDPNSPMSITEYNGSALVAMVGKNCFAIASDRRLGVQLQTVATDFKRISQVHDRLFIGLSGLATDAQTLYQRLMFRHKLYQLREERDMKPETFASLVSAILYEKRFGPYFTQPVIAGLSDEDRPFICTTDSIGAKELAKDFVVAGTASESLYGACEAMFKPDMEPEELFETVSQALLSSVDRDCLSGWGGHVFVVTPT

SEQ ID NO: 542 - protein, 218 aa, Malus x domestica
VMAGYRAEDDYDYLFKVVLIGDSGVGKSNLLSRFTRNEFSLESKSTIGVEFATRSLDVDGKVIKAQIWDTAGQERYRAITSAYYRGAVGALLVYDVTRNSTFESVERWLKELRDHTDPNIVVMLVGNKSDLRHLVAVSTEDGKSFAERESLYFMETSALEATNVDNAFSEVLTQIFRVVSRKAMESGNEGAASAVPQGEKIDVGKDVSAVKKGGCCST

SEQ ID NO: 543 - protein, 496 aa, Malus x domestica
  misc_feature (144)..(144): Xaa can be any naturally occurring amino acid
MPPILPDFSNSVKLKYVKLGYQYLVNHILTLTLIPIMAGILLEVLRLSPDELLKLWDSLHFDLVQILCSSFLIIFIATVYFMSKPRPIYLVDYACFKPPVMCRVPFSTFMEHSRLILSNNPKSVEFQMRILERSGLGEETCLPXAIHYIPPNPTMEAARGEAELVIFSAMDSLFEKTGLKPKDIDILIVNCSLFSPTPSLSAMVINKYKLRSNIKSFNLSGMGCSAGLISIDLARDLLQVHPNSNAVVVSTEIITPNYYQGNERAMLLPNCLFRMGGAALLLSNRRSEHRRAKYRLVHVVRTHKGADDKAYKCVFEEEDKEGKVGISLSKDLMAIAGEALKSNITTIGPLVLPASEQLLFLITLIGRKILNPKWKPYIPDFRQAFEHFCIHAGGRAVIDELQKNLQLSAEHCEASRMTLHRFGNTSSSSLWYELGYIEAKGRMRKGDRVWQIAFGSGFKCNSAVWKCNRAIKTASDGPWADCIDRYPVHIPEVVKL

SEQ ID NO: 544 - protein, 164 aa, Prunus armeniaca
SLSLSLSRSPRFSRHFSLPRHFLGKMANAASGMAVHDECKLKFLELKAKRTYRFIVYKIEEKQKQVIVEKVGEPADSYEDFSASLPTDECRYAVYDFDYVTEENCQKSRIIFIAWSPDTSKVRSKMIYASSKDRFKRELDGIQVELQATDPTEMGLDVIRSRAT

SEQ ID NO: 545 - protein, 216 aa, Prunus armeniaca
HEERERERERERERERERERERERERERERERERESIHSKSSKHRATYKRSRESFIVSESHRFSAHFSFWPRFSATSMANAASGFAVDDDCKLKFLELKAKRTYRFIVFKIEEEQKQVIVEKLGEPAESYENFTASLPADECRYAVYDFDFVTEENCQKSRIFFIAWSPDTSRVRSKMIYASSKDRFKRELDGIQVELQATDPTEIGLDVIKSRAS

SEQ ID NO: 546 - protein, 393 aa, Aquilegia formosa
GLTESLFLSHKDEYPEHEQASLRQLYQAKMEEVRAESQQQSESTGTIGRSKGASLPSSHQQISVTVVTEFVRWNEEAISRCTLFSSQPATLANTVKTVFTCLLDQVSQYITEGLERARDSLNEAAALRERFVLGTNLSRRVAAAAASAAEAAAAAGESSFRSFMVAVQRCASSVAIVQQYFTNSISRLLLPVDGAHAASCEEMATAMSSAEGAAYKGLQQCIETVMAEVERLLSAEQKATDYRSPDDGIAPDHRPTSACTRVVAYLSRVLEVAFTALEGLNKQAFLTELGNRLHKGLLSHWQKYTFNPSGGLRLKRDITEYGEFVRSFNAPSVDEKFELLGIMANVFIVAPESLNTLFEGTPSIRKDAQRFIQLREDFKSAKLASKLSSLWSS

SEQ ID NO: 547 - protein, 218 aa, Aquilegia formosa
MAAYRADDDYDYLFKVVLIGDSGVGKSNLLSRFTKNEFSLESKSTIGVEFATRSLNVDTKVIKAQIWDTAGQERYRAITSAYYRGAVGALLVYDVTRHATFENTERWLKELRDHTDPNIVVMLIGNKSDLRHLVAVSTEDGKSFAERESLYFMETSALEATNVENAFAEVLTQIYRIVSKKSMETGDDGAAANVPTKGEKLNVKDDVSALKRVGCCSS

SEQ ID NO: 548 - protein, 353 aa, Aquilegia formosa
VNEFTAEREQHGTVDDQWVNEFSKLRVDDWADEFEHQVGEGALGDNWASSYDEFLNEQVVKQRSDTSRGVYVFSDVNPYVGHPNPLKEGQELFRKGLLSEAVLALEAEVLKNPDNSEGWRLLGITHAENDDDQQAIASMMRAQEVDPTNLEVLLALGVSHTNELEQAAALKYLYSWLQHHPKYGTLAPPEQINSLYYADVARLFNEAAQISPEDADVHIVLGVLYNLSREYDKAIASFETALKLKPRDYSLWNKLGATQANSVQSADAILAYQQALDLKPNYVRAWANMGISYANQGLYEDSIRYYVRALAMNPKADNAWQYLRISLSCASRNDMMEACDSRNLDVLQKEFPL

SEQ ID NO: 549 - protein, 204 aa, Arabidopsis thaliana
MSIFEYNGSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGDDDKPFICTMDSIGAKELAKDFVVSGTASESLYGACEAMYKPDMEAEELFETISQALLSSVDRDCLSGWGGHVYIVTPTEIKERILKGRMD

SEQ ID NO: 550 - protein, 237 aa, Arabidopsis thaliana
QAIVDFNNCSSLAQISSPIGKLPKLHSVNPNFPMSIFEYNGSAVVAMVGKNCFAIASDRRLGVQLQTIATDFQRISKIHDHLFIGLSGLATDVQTLYQRLVFRHKLYQLREERDMKPETFASLVSAILYEKRFGPFLCQPVIAGLGDDNKPFICTMDSIGAKELAKDFVVSGTASESLYGACEAMFKPDMEAEELFETISQALLSSVDRDCLSGWGGHVYVVTPKEVKERILKGRMD

SEQ ID NO: 551 - protein, 217 aa, Arabidopsis thaliana
MGKEDDRGEEYLFKIVLIGDSAVGKSNLLSRFSRDEFDTNSKATIGVEFQTQLVEIEGKEVKAQIWDTAGQERFRAVTSAYYRGAFGALIVYDITRGDTFESVKRWLQELNTHCDTAVAQMLVGNKCDLEDIRAVSVEEGKALAEEEGLFFMETSALDATNVDKAFEIVIREIFNNVSRKLLNSDAYKAELSVNRVSLVNNQDGSESSWRNPSCCSR

SEQ ID NO: 552 - protein, 137 aa, Arabidopsis thaliana
MANAASGMAVHDDCKLKFMELKAKRTFRTIVYKIEDKQVIVEKLGEPEQSYDDFAASLPADDCRYCIYDFDFVTAENCQKSKIFFIAWSPDTAKVRDKMIYASSKDRFKRELDGIQVELQATDPTEMGLDVFKSRTN

SEQ ID NO: 553 - protein, 139 aa, Arabidopsis thaliana
MANAASGMAVHDDCKLRFLELKAKRTHRFIVYKIEEKQKQVVVEKVGQPIQTYEEFAACLPADECRYAIYDFDFVTAENCQKSKIFFIAWCPDIAKVRSKMIYASSKDRFKRELDGIQVELQATDPTEMDLDVFRSRAN

SEQ ID NO: 554 - protein, 150 aa, Arabidopsis thaliana
MVSSIFHLLSRSANAASGMAVHDDCKLRFLELKAKRTHRFIVYKIEEKQKQVVVEKVGQPIQTYEEFAACLPADECRYAIYDFDFVTAENCQKSKIFFIAWCPDIAKVRSKMIYASSKDRFKRELDGIQVELQATDPTEMDLDVFRSRAN

SEQ ID NO: 555 - protein, 214 aa, Arabidopsis thaliana
MAGYRADDDYDYLFKVVLIGDSGVGKSNLLSRFTRNEFSLESKSTIGVEFATRSLNVNEKVIKAQIWDTAGQERYRAITSAYYRGAVGALLVYDVTRHSTFENVERWLRELRDHTDPNIVVMLVGNKSDLRHLVAVQTEDAKSFAENESLYFMETSALESTNVENAFSEVLTQIYHVVSKKAMEAGEDSGNVPSKGEKIDVDVSAVKKTGCCSN

SEQ ID NO: 556 - protein, 825 aa, Arabidopsis thaliana
MDISNEASVDPFSIGPSSIMGRTIAFRVLFCRSMSQLRRDLFRFLLHWFLRFKLTVSPFVSWFHPRNPQGILAVVTIIAFVLKRYTNVKIKAEMAYRRKFWRNMMRTALTYEEWAHAAKMLEKETPKMNESDLYDEELVKNKLQELRHRRQEGSLRDIMFCMRADLVRNLGNMCNSELHKGRLQVPRHIKEYIDEVSTQLRMVCNSDSEELSLEEKLSFMHETRHAFGRTALLLSGGASLGAFHVGVVRTLVEHKLLPRIIAGSSVGSIICAVVASRSWPELQSFFENSLHSLQFFDQLGGVFSIVKRVMTQGALHDIRQLQCMLRNLTSNLTFQEAYDMTGRILGITVCSPRKHEPPRCLNYLTSPHVVIWSAVTASCAFPGLFEAQELMAKDRSGEIVPYHPPFNLDPEVGTKSSSGRRWRDGSLEVDLPMMQLKELFNVNHFIVSQANPHIAPLLRLKDLVRAYGGRFAAKLAHLVEMEVKHRCNQVLELGFPLGGLAKLFAQEWEGDVTVVMPATLAQYSKIIQNPTHVELQKAANQGRRCTWEKLSAIKSNCGIELALDDSVAILNHMRRLKKSAERAATATSSSHHGLASTTRFNASRRIPSWNVLARENSTGSLDDLVTDNNLHASSGRNLSDSETESVELSSWTRTGGPLMRTASANKFIDFVQSLDIDIALVRGFSSSPNSPAVPPGGSFTPSPRSIAAHSDIESNSNSNNLGTSTSSITVTEGDLLQPERTSNGFVLNVVKRENLGMPSIGNQNTELPESVQLDIPEKEMDCSSVSEHEEDDNDNEEEHNGSSLVTVSSEDSGLQEPVSGSVIDA

SEQ ID NO: 557 - protein, 216 aa, Arabidopsis thaliana
MAGYRADDEYDYLFKVVLIGDSGVGKSNLLSRFTKNEFSLESKSTIGVEFATRSLNVDDKVIKAQIWDTAGQERYRAITSAYYRGAVGALLVYDVTRHSTFENVETWLKELRNHTDPNIVVMLVGNKSDLRHLVAVQTEDAKSFAEKESLYFMETSALEATNVENAFAEVLTQIHHIVSKKAMEAASESANVPSKGDKIDIGKDVSAVKKGGCCSN

SEQ ID NO: 558 - protein, 139 aa, Arabidopsis thaliana
MANAASGMAVHDDCKLRFLELKAKRTHRFIVYKIEEKQKQVIVEKVGEPILTYEDFAASLPADECRYAIYDFDFVTAENCQKSKIFFIAWCPDVAKVRSKMIYASSKDRFKRELDGIQVELQATDPTEMDLDVLKSRVN

SEQ ID NO: 559 - protein, 139 aa, Brassica oleracea
MANAASGMAVHDDCMLKFLELKAKRTYRFIVYKIEEQQKQVVVEKLGEPGQSHDDFAASLPADECRYAIFDFDFVTAENCQKSKIFFIAWSPDTARVRSKMIYASSKDRFKRELDGIQVELQATDPTEMDLDIFKSRAN

SEQ ID NO: 560 - protein, 139 aa, Brassica oleracea
MANAASGMAVHDDCKLKFLELKAKRTYRFIVYKIEEQQKQVVVEKLGEPGQSHDDFAASLPADECRYAIFDFDFVTAENCQKSKIFFIAWSPDTARVRSKMIYASSKDRFKRELDGIQVELQATDPTEMDLDIFKSRAN

SEQ ID NO: 561 - protein, 139 aa, Brassica oleracea
MANAASGMAVHDDCKLRFLELKAKRTHRFIVYKIEEKQKQVVVEKVGEPVLSYEDFAASLPAEECRYAIYDFDFVTTENCQKSKIFFIAWCPDVAKVRSKMIYASSKDRFKRELDGIQVELQATDPTEMDLDVFKSRVN

SEQ ID NO: 562 - protein, 139 aa, Brassica oleracea
MANAASGMAVHDDCKLKFLELKAKRTFRFIVYKIEEQQKQVVVEKLGEPGQSHDDFAASLPADECRYAVFDFDFVTAESCQKSKIFFVAWSPDTARVRSKMIYASSKDRFKRELDGIQVELQATDPTEMDLDVFKSRAN

SEQ ID NO: 563 - protein, 137 aa, Brassica oleracea
MANAASGMAVHDDCKLKFLELKAKRTFRTIVYKIEDKQVIVEKLGEPEQSYDDFAASLPDNECRYAIYDFDFVTEENCQKSKIFFIAWSPDTAKVRDKMIYASSKDRFKRELDGIQVELQATDPTEMGLDVFKSRTN

SEQ ID NO: 564 - protein, 139 aa, Brassica oleracea
MANAASGMAVHDDCKLKFLELKAKRTYRFIVYKIEEQQKQVVVEKLGEPGQSHDDFAASLPADECRYAIFDFDFVTAENCQKSKIFFVAWSPDTARVRSKMIYASSKDRFKRELDGIQVELQATDPTEMDLDVFKSRAN

SEQ ID NO: 565 - protein, 204 aa, Brassica oleracea
  misc_feature (179)..(179): Xaa can be any naturally occurring amino acid
MSIFEYNGSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGEDDKPFICTMDSIGAKELAKDFVVSGTASESLYGACEAMYKPDMEAEELFETISQALLSSVDRDCXSGWGGHVYVVTPTEIKERILKGRMD

SEQ ID NO: 566 - protein, 139 aa, Brassica oleracea
MANAASGMAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSKDRFKRELDGIQVELQATDPTEMDLDVFKSRVN

SEQ ID NO: 567 - protein, 137 aa, Brassica rapa
MANAASGMAVHDDCKLKFLELKAKRTFRTIVYKIEDKQVIVEKLGEPEQSYDDFAASLPENECRYAIYDFDFVTEENCQKSKIFFIAWSPDTAKVRDKMIYASSKDRFKRELDGIQVELQATDPTEMGLDVFKSRTN

SEQ ID NO: 568 - protein, 139 aa, Brassica rapa; identical to SEQ ID NO: 564

SEQ ID NO: 569 - protein, 139 aa, Brassica rapa; identical to SEQ ID NO: 560

SEQ ID NO: 570 - protein, 150 aa, Brassica rapa
PRVRNVRNFDVVPQECVSHVKKYMTSSQYEDDVERAVDEVILHFGSMCCTKTKCDGMDAWIFDIDDTLLSTIPYHEKNGFFGGEKLNSTKFEDWMRKRKAPPVPHMVKLYHDIRERGIKIFLVSSRKEYLRSATVDNLIQAGTMAGPPHP

SEQ ID NO: 571 - protein, 139 aa, Brassica rapa; identical to SEQ ID NO: 562

SEQ ID NO: 572 - protein, 139 aa, Brassica rapa
MANAASGMAVHDDCKLRFLELKAKRTHRFIVYKIEEKQKQVVVEKVGEPILSYEDFAASLPAEECRYAIYDFDFVTTENCQKSKIFFIAWCPDVAKVRSKMIYASSKDRFKRELDGIQVELQATDPTEMDLDVFKSRVN

SEQ ID NO: 573 - protein, 211 aa, Brassica rapa
MGKEDNQGEEYLFKIVLIGDSAVGKSNLLSRFSRDEFDTNSKATIGVEFQTQLVEIEGKEVKAQIWDTAGQERFRAVTSAYYRGAFGALIVYDITRSSTFESVKRWLQELNTHCDTAVAQMLVGNKCDLEDIRAVSVEEGKALAEEEGLFFMETSALDATNVDKAFEIVIREIFSNVSRKLLNSDAYKAQLSVNRVSLVNNGDGRTELFLL

SEQ ID NO: 574 - protein, 139 aa, Musa acuminata
MANAASGMAVNDDCKLKFLELKAKRTYRFVIFKIDEKQKEVVVEKVGEPSSSYEDFAASLPTDECRYAIYDFDFVTEENLQKSKIFFIAWSPDSSRVRSKMLYASSKDRFKRELDGIQVELQATDPTEMGLDVFRSRAN

SEQ ID NO: 575 - protein, 204 aa, Musa acuminata
MSIFEYNGSALVAMVGKNCFAIASDRRLGVNLQTVATDFQRIFKIHDKLYIGLSGLATDAQTMYQRLVFRHKLYQLREERDMKPQTFASLVSALLYEKRFGPYFCQPVIAGLGDDDVPFICTMDCLGAKELAKDFVVSGTASESLYGACESMYKPNMEPEELFETISQALLSSVDRDCLSGWGGHVLLVTPTEVQERTLKGRMD

SEQ ID NO: 576 - protein, 238 aa, Hordeum vulgare
RHEATSPDHQQRRRPLLLLPPLQSNPATPRLRPAMSIFEYNGSAVVAMVGKNCFAIASDRRLGVQLQTVATDFQRVFKIHGKLYIGLSGLASDAQTLYQRLVFKHKLYQLREERDMKPETFASLVSSMLYEKRFGPYFCQPIIAGLGQDDEPFICTMDCIGAKELAKDFVVSGTASESLYGACESMYKPNMEPEELFETISQALLSSVDRDCLSGWGGYVLIVTPTEVQERVLKGRMD

SEQ ID NO: 577 - protein, 242 aa, Hordeum vulgare
ERTRRFSFRRRIHNRSRRAPPPPLAPPPPSPSVASLSAMSIFEYNGSAVVAMVGKNCFAIASDRRLGVQLQTVATDFQRVFKIHGKLYIGLSGLASDAQTLYQRLVFKHKLYQLREERDMKPETFASLVSALLYEKRFGPYFCQPIIAGLGENDQPFICTMDCIGAKELAKDFVVSGTASESLYGACESMYKPDMEPEELFETISQALLSSVDRDCLSGWGGYVLIVTPTEVQERVLKGRMD

SEQ ID NO: 578 - protein, 204 aa, Ocimum basilicum
  misc_feature (101)..(101): Xaa can be any naturally occurring amino acid
  misc_feature (187)..(187): Xaa can be any naturally occurring amino acid
MSIFEYNGSALVAMVGKNCFAIASDRRLGVQLQTIATDFQKIYRIHDKLFIALAGLATDAQTLYQKLVFRHKLYHLREERDMKPETFASLVSALLYEKRFXPFFCQPVIAGLGDDDKPFICTMDSIGAKELAKDFVVAGTASESLYGACESMFKPDMEAEELFETISQALLASVDRDCLSGWGGHVXLVTPTEVKERILKGRMD

SEQ ID NO: 579 - protein, 139 aa, Brassica napus; identical to SEQ ID NO: 560

SEQ ID NO: 580 - protein, 139 aa, Brassica napus; identical to SEQ ID NO: 572

SEQ ID NO: 581 - protein, 137 aa, Brassica napus; identical to SEQ ID NO: 563

SEQ ID NO: 582 - protein, 139 aa, Brassica napus; identical to SEQ ID NO: 564

SEQ ID NO: 583 - protein, 139 aa, Brassica napus; identical to SEQ ID NO: 561

SEQ ID NO: 584 - protein, 139 aa, Brassica napus; identical to SEQ ID NO: 566

SEQ ID NO: 585 - protein, 139 aa, Brassica napus; identical to SEQ ID NO: 560

SEQ ID NO: 586 - protein, 139 aa, Brassica napus; identical to SEQ ID NO: 562

SEQ ID NO: 587 - protein, 204 aa, Brassica napus
MSIFEYNGSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGEDDKPFICTMDSIGAKELAKDFVVSGTASESLYGACEAMYKPDMEAEELFETISQALLSSVDRDCLSGWGGHVYVVTPTEIKERILKGRMD

SEQ ID NO: 588 - protein, 139 aa, Brassica napus; identical to SEQ ID NO: 562

SEQ ID NO: 589 - protein, 139 aa, Brassica napus; identical to SEQ ID NO: 562

SEQ ID NO: 590 - protein, 204 aa, Brassica napus
MSIFEYNGSAVVAMVGKNCFAIASDRRLGVQLQTIATDFQRISKIHDRVFIALSGLATDVQTLYQRLVFRHKLYQLREERDMKPETFASLVSAILYEKRFGPYLCQPVIAGLGEDEKPFICTMDSIGAKELAKDFVVSGTASESLYGACEAMYKPDMEAEELFETISQALLSSVDRDCLSGWGGHVYVVTPTEIKERILKGRMD

SEQ ID NO: 591 - protein, 139 aa, Brassica napus; identical to SEQ ID NO: 572

SEQ ID NO: 592 - protein, 139 aa, Brassica napus; identical to SEQ ID NO: 566

SEQ ID NO: 593 - protein, 139 aa, Brassica napus; identical to SEQ ID NO: 566

SEQ ID NO: 594 - protein, 204 aa, Brassica napus
MSIFEYNGSAVVAMVGKNCFAIASDRRLGVQLQTIATDFQRISKIHDRVFIALSGLATDVQTLYQRLVFRHKLYQLREERDMKPETFASLVSAILYEKRFGPYLCQPVIAGLGEDDKPFICTMDSIGAKELAKDFVVSGTASESLYGACEAMYKPDMEAEELFETISQALLSSVDRDCLSGWGGHVYVVTPTEIKERILKGRMD

SEQ ID NO: 595 - protein, 214 aa, Brassica napus
MAGYKADDDYDYLFKVVLIGDSGVGKSNLLSRFTRNEFSLESKSTIGVEFATRSLTVKDKVIKAQIWDTAGQERYRAITSAYYRGAVGALLVYDVTRHSTFENVERWLRELRDHTDPNIVVMLVGNKSDLRHLIAVQTEDAKSFAENESLYFMETSALESTNVENAFSEVLTQIHQVVSKKAMEAGDDSGNVPSKGEKIDIDVSAVKKTGCCSN

SEQ ID NO: 596 - protein, 191 aa, Brassica napus
MVGKNCFAIASDRRLGVQLQTIATDFKRISKIHDRLFIGLSGLATDVQTLYQRLVFRHKLYQLREERDMKPETFASLVSAILYEKRFGPYLCQPVIAGFGEDDKPFICTMDSIGAKELAKDFVVSGTASESLYGACEAMYKPDMEAEELFETISQALLSSVDRDCLSGWGGHVYVVTPNEIKERILKGRMD

SEQ ID NO: 597 - protein, 216 aa, Brassica napus
MAGYKADDEYDYLFKVVLIGDSGVGKSNLLSRFTKNEFSLESKSTIGVEFATRSLNVDDKVIKAQIWDTAGQERYRAITSAYYRGAVGALLVYDVTRHSTFENVETWLKELRNHTDPNIVVMLVGNKSDLRHLVAVQTDDAKSFAEKESLYFMETSALDSTNVENAFAEVLTQIHCIVSRKAMEAASESANVPSKGDKIDLGKDVSAVKKGGCCSN

SEQ ID NO: 598 - protein, 204 aa, Brassica napus
  misc_feature (2)..(2): Xaa can be any naturally occurring amino acid
  misc_feature (145)..(145): Xaa can be any naturally occurring amino acid
MXIFEYNGSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGEDDKPFICTMDSIGAKELAKDFVVSGTASESXYGACEAMYKPDMEAEELFETISQALLSSVDRDCLSGWGGHVYVVTPTEIKERILKGRMD

SEQ ID NO: 599 - protein, 139 aa, Brassica napus; identical to SEQ ID NO: 560

SEQ ID NO: 600 - protein, 139 aa, Ricinus communis
MANAASGMAVHDDCKLRFLELKAKRTYRFIVFKIEEKQKQVIVEKVGEPAQSYEDFTASLPADECRYAVYDFDFVTAENCQKSRIFFIAWSPDTSRVRSKMIYASSKDRFKRELDGIQIELQATDPTEMGLDVFRSRAN

SEQ ID NO: 601 - protein, 834 aa, Ricinus communis
MKDSKDGDKISKSASVGSLPLILDIDDFKGEFSFDALFGNLVNELLPSFQEEEADSAEGHGNIGGSDVLANGHVRAPSDAIKFSQGQSPLFPEVDSLLSLFRDSCRELIDLRKQVDGKLSNLRKDVSVQDSKHRKTLAELEKGVDGLFDSFARLDSRISSVGQTAAKIGDHLQSADAQRETAGQTIELIKYLMEFNGSPGDLMELSPLFSDDSRVAEAATIAQKLRSFAEEDIGRQGMSVASDMGNATASRGLEVAVANLQDYCNELENRLLARFDASSQRRELSTMAECAKILSRFNRGTSAMQHYVATRPMFIDVEVMNADTRLVLGDQVSQASPSSVARGLSSLYKEITDTVRKEAATITAVFPSPNDVMSILVQRVLEQRVTALLDKLLVKPSLVNLPPMEEGGLLLYLRMLAVAYEKTQELARDLRAVGCGDLDVEGLTESLFSSHKDDYPEHEQTSLRQLYRAKMEELRAESQQLSESTGTIGRSKGASVASSHQQISVTVVTEFVRWNEEAISRCTLFSSQPTILAANVKPVFTCLLDQVGQYITEGLERARDSLTEAAALRERFVLGTNLSRRVAAAAASAAEAAAAAGESSFRSFMVAVQRCGSSVAIVQQCFANSISRLLLPVDGAHAASCEEMATAMSSAESAAYKGLQQCIETVMAEVERLLSAEQKATDYRSPDDGIAPDHRPTSACTRVVAYLSRVLETAFTALEGLNKQAFLTELGNRLHKGLLNHWQKFTFNPSGGLRLKRDITEYGEFVRSFNAPSVDEKFELLGIMANVFIVAPESLSTLFEGTPSIRKDAQRFIQLREDYKSAKLASKLNSLWTS

SEQ ID NO: 602 - protein, 442 aa, Ricinus communis
MKDSKDGDKISKSASVGSLPLILDIDDFKGEFSFDALFGNLVNELLPSFQEEEADSAEGHGNIGGSDVLANGHVRAPSDAIKFSQGQSPLFPEVDSLLSLFRDSCRELIDLRKQVDGKLSNLRKDVSVQDSKHRKTLAELEKGVDGLFDSFARLDSRISSVGQTAAKIGDHLQSADAQRETAGQTIELIKYLMEFNGSPGDLMELSPLFSDDSRVAEAATIAQKLRSFAEEDIGRQGMSVASDMGNATASRGLEVAVANLQDYCNELENRLLARFDASSQRRELSTMAECAKILSRFNRGTSAMQHYVATRPMFIDVEVMNADTRLVLGDQVSQASPSSVARGLSSLYKEITDTVRKEAATITAVFPSPNDVMSILVQRVLEQRVTALLDKLLVKPSLVNLPPMEEGGLLLYLRMLAVAYEKTQELARDLRAVGCGDLDVEG

SEQ ID NO: 603 - protein, 202 aa, Ricinus communis
IFEYNGSALIAMVGKNCFAIASDRRLGVQLQTIATDFQRIYKIHDRLFLGLSGLATDAQTLYQRLVFRHKLYQLREERDMNPETFASLVSALLYEKRFGPYFCQPVIAGLSDENKPFICTMDSIGAKELARDFVVAGTASESLYGACESMFKPDLEAEELTEIISQALLSSVDRDCLSGWGGHVYVVTPTEVTERILKGRMD

SEQ ID NO: 604 - protein, 218 aa, Ricinus communis
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDNAFAEVLTQIYRIVSKKAMETGDEGAASAVPSKGEKIDVSKDVSAMKRVGCCSS

SEQ ID NO: 605 - protein, 366 aa, Ricinus communis
VPHGPEQWGNEFAAERGQNGSVDDQWVNEFSKLHVNDWVEEFGQQVEEGALGDSSVDNWANAYDEYMNEQVAAKQQSDASRGVYVFSDMNPYVGHPNPLKQGQDLFHKGLLSESVLALEAEVLKNPDNAEGWRLLGIANAENDDDQQAIAAMMRAQEADPANLEVLLALGVSHTNELEQAAALKYLYGWLRNHPKYGSLASPELADSLYYADVARLFNDASQMSPEDADVHIVLGVLYNLSREYDKAIASFQTALKLKPQDYSLWNKLGATQANSVQSADAIYAYQQALDLKPNYVRAWANMGISYANQGMYEDSIRYYVRALAMNPKADNAWQYLRISLSCASRNDMLEACDSRNIDLLQKEFPL

SEQ ID NO: 606 - protein, 216 aa, Ricinus communis
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVTTEDAKAFAERESTFFMETSALESLNVENAFTEVLTQIYRVVSRKALDVGDDPAALPKGQTINVGKDDVSAVKKVGCCSA

SEQ ID NO: 607 - protein, 139 aa, Ricinus communis
MANAASGMAVHDDCKLKFLELKAKRSHRFIVFKIEMVQKQVVVEKLGQPTDSYEDFAASLPADECRYAVYDFDYVTDENCQKSRIVFIAWSPDTAKVRNKMIYASSKDRFKRELDGIQVELQATDPTEMGLDVIRSRSN

SEQ ID NO: 608 - protein, 162 aa, prunus avium
EERPFPISSPPSSSPTKPKQREKMANAASGMAVHDDCKLKFLELKAKRTYRSIVFKIEEKQKQVVVESVGEPTETYEQFAEKLPADECRYAVFDFDFLTPEGVQKSRIFFIAWSPDTSRVRSKMIYASSKDRFKRELDGIQIELQATDPTEIGLDVIKSRAS

SEQ ID NO: 609 - protein, 139 aa, Citrus sinensis
MANAASGMAVHDDCKLKFLELKAKRTYRFIVFKIEEKQKQVIVEKLGEPTQTYEDFAASLPAEECRYAVYDYDFVTAENCQKSRIFFIAWSPDTARVRSKMIYASSKDRFKRELDGIQVELQATDPSEMGLDVFKDRAN

SEQ ID NO: 610 - protein, 204 aa, Citrus sinensis
MSITEYNGSALVAMVGKNCFAIASDRRLGVQLQTIATDFQRISKIHDRLFIGLSGLATDSQTLYQRLVFRHKLYQLREERDMKPETFASLVSALLYEKRFGPYFCQPVIAGLSDEDKPFICTMDSIGAKELAKDFVVAGTAGESLYGACEAMFKPDMEPDELFETVSQALLSSVDRDCLSGWGGHVYIVTPTEIKERILKGRMD

SEQ ID NO: 611 - protein, 171 aa, Citrus sinensis
SAASVLLSLSHYRIPRFSLNFPHFLSPFFLQKMANAASGMAVDDDCKLKFLELKAKRTYRFIVFKIEEKQKQVVVEKLGEPSDSYENFTASLPADECRYAVYDFDFVTDENCQKSKIIFIAWSPDTSKVRSKMIYASSKDRFKRELDGIQVELQATDPTEMGLDVMRSRTN

SEQ ID NO: 612 - protein, 218 aa, Citrus sinensis
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLFFMETSALEATNVDNAFAEVLTQIYRIVSKKAMETGEDGGNSAVPSKGEKIDVSKDVSAVKKGGCCST

SEQ ID NO: 613 - protein, 874 aa, Citrus sinensis
  misc_feature (13)..(14): Xaa can be any naturally occurring amino acid
CRHLGSIYYPTEXXRKTQKACISYPSLCCLAPSLAEEMKESRDGIGHDRISKSSSVSSIPLILDIDDFKGDFSFDALFGNLVNELLPSFQEEEADSADGHGNVSGNDTLPNGHKRASSDAIKFTQGLAAPLFPEVDALSSLFKDSCRELIDLRKQIDDRLFNLKKELSVQDSKHRKTLAELEKGVDGLFDSFARLDSRISSVGQTAAKIGDHLQSADAQRVTASQTIDLIKYLMEFNSSPGDLMELSPLFSDDSRVAEAASIAEKLRSFAEEDIGRQGIQDMGNANASRGLEVAVANLQDYCNELENRLLSRFDAASQRRELSTMSECAKILSQFNRGTSAMQHYVATRPMFIDVEVMNADVRLVLGDQGSQASPSNVARGLASLYKEITDTVRKEAATITAVFPSPNYVMSILVQRVLEQRVTAILDKLLVKPSLVNLPPMEEGGLLLYLRMLAVAYEKTQELARDLRTVGCGDLDIEGVTECLFTSHKEEYPEHEQASLRQLYQAKMEELRSESQQLSESSGTIGRSKGASVASSPQQISVTVVTEFVRWNEEALSRCTLFSSQPAALAANVRAVFTCLLDQVSQYITEGLERARDSLTEAAALRERFVLGTSVSRRVAAAAASAAEAAAAAGESSFRSFMVAVQRCGSSVAIVQQYFANSISRLLLPVDGAHAASCEEMATAMSSAEAAAYKGLQQCIETVMAEVERLLSAEQKPSDYKSPDDGIAPDHRPTNACTRVVAYLSRVLEAAFTALEGLNKQAFLTELGNRLHKGLLNHWQKFTFNPSGGLRLKRDITEYGEFVRSFNAPSVDEKFELLGIMANVFIVAPESLSTLFEGTPSIRKDAQRFIQLREDYKSAKLASRLSSLWASST

SEQ ID NO: 614 - protein, 139 aa, Citrus sinensis
MANAASGMAVDDDCKLKFLELKAKRTYRFIVFKIEEKQKQVVVEKLGEPSDSYENFTASLPADECRYAVYDFDFVTDENCQKSKIIFIAWSPDTSKVRSKMIYASSKDRFKRELDGIQVELQATDPTEMGLDVMRSRSN

SEQ ID NO: 615 - protein, 204 aa, Citrus sinensis; identical to SEQ ID NO: 610

SEQ ID NO: 616 - protein, 520 aa, Citrus sinensis
  misc_feature (348)..(348): Xaa can be any naturally occurring amino acid
DFLSCTQFSFTNEIKSRAQKKKKKMPQILPDFSNSVKLKYVKLGYQYLVNHILYLLLVPIMVAILIEVLRLGPYEILNLWKSLHFDLVQILCSSFLIIFIATVYFMSKPRHVYLVDYACYKPPVTCRVPFATFMEHSRLILKNNPKSVEFQMRILERSGLGEETCLPPAIHYIPPTPTMEAARGEAELVIFSAMDSLLQKTGLKPKDIDILIVNCSLFSPTPSLSAMLINQYKLRSNIKSFNLSGMGCSAGLISIDLARDLLQVHPNSNAVVVSTEIITPNYYQGNERAMLLPNCLFRMGGAAILLSNRRRNRSRAKYRLVHVVRTHKGADDKAYRCVFEEEDKEGKXGISLSKDLMAIAGEALKSNITTIGPLVLPASEQLLFLMTLIGRKIFNPKWKPYIPDFKQAFEHFCIHAGGRAVIDELQKNLQLSAEHVEASRMTLHRFGNTSSSSLWYEMSYIEEKGRMKKGDRVWQIAFGSGFKCNSAVWKCNKTIKTTTDNPWSDCIDRYPVHIPEIVKL

SEQ ID NO: 617 - protein, 56 aa, Citrus sinensis
MQHQRIGSQGSWRASIMRSRQLTPLRWILKSLGTVLTEHLEKHPGVTKRNAFSCFN

SEQ ID NO: 618 - protein, 139 aa, Coffea arabica
MANAASGMAVHDDCKLRFLELKAKRTYRFIVYKIEEKQKQVVVEKVGEPTKSYEDFTASLPVDECRYAVYDFDFVTAENCQKSRIFFIAWSPDTSRVRSKMIYASSKDRFKRELDGIQVELQATDPTEMGLDVIKSRAS

SEQ ID NO: 619 - protein, 139 aa, Coffea arabica
MANAASGMAVHDDCKLKFLELKAKRTYRFIVFKIEEKQKQVIVEKVGEPGQSYEDFAASLPADECRYAVFDFDFVTAENCQKSRIFFIAWSPDTSKVRSKMIYASSKDRFKRELDGIQVELQATDPTEMGLDVFKSRAN

SEQ ID NO: 620 - protein, 249 aa, Coffea arabica
  misc_feature (231)..(231): Xaa can be any naturally occurring amino acid
LSLTSRTSPPFALLKQEEKKPSTAPEFPTNESKKMAEEEGEEYLFKIVVIGDSAVGKSNLLSRFARDEFDHNSKATIGVEFQTQVVEVDGKEIKAQVWDTAGQERFRAVTSAYYRGAVGALIVYDISRKTTFESTKRWLDELNTHCDTTVARMLVGNKCDLEDIRDVSVEEGKSLAEEEGLFFIETSALNSTNVNAAFEIVIREIYNNVSRKTLNSDSYKAELSVNRVSLXNGIDLSKQNKSFSSCCSR

SEQ ID NO: 621 - protein, 142 aa, Coffea arabica
MANAASGMAVHDDCKLKFLELKAKRTYRFIIYKIEEKQKQVIVEKLGEPANGYEEFTANLPADECRYAVYDYDFMTEENVPKSRIFFIAWSPDTSKVRSKMIYASSKDRFKRELDGIQVELQATDPTEIGLDVIKSRAGGAA

SEQ ID NO: 622 - protein, 204 aa, Coffea arabica
MSIFEYNGSALVAMVGKNCFAIASDRRLGVQLQTIATDFQRIYRIHDKLFIGLSGLATDAQTLYQRLVFRHKLYQLREERDMKPETFASLVSAILYEKRFGPYFCQPVIAGLGEEDKPFICTMDSIGAKELAKDFVVAGTASESLYGACEAMFKPDMEAEELFETISQALLSSVDRDCLSGWGGHVYVVTPTEVKERILKGRMD

SEQ ID NO: 623 - protein, 218 aa, Coffea arabica
MAGYRAEDDYDYLFKVVLIGDSGVGKSNLLSRFTRNEFSLESKSTIGVEFATRSLNVDNKVIKAQIWDTAGQERYRAITSAYYRGAVGALLVYDVTRHSTFENVERWLRELRDHTDPNIVVMLVGNKSDLRHLVAVSTEDGKSFAERESLYFMETSALEATNVDSAFAEVLTQIYHIVSKKAMEAGENGANGTVPSKGEKIDVGKDVSAMKKGGCCST

SEQ ID NO: 624 - protein, 492 aa, Gossypium hirsutum
MPHFSNSVKLKYVKLGYQYLVNHILTLTLIPVMAGVLIEVLRLGPAGIVSLWNSLHFDLVHILCSCFFIIFVATVYFMSKPRSIYLVDYACYKPPVTCRVPFATFMEHSRLNLSNNPKSVEFQMRILERSGLGEETCLPPAIHYIPPTPTMEAARGEAEIVIFSAMDSLFKKTGLKPKDVDILIVNCSLFSPTPSLSAMVINKYKLRSNIKSFNLSGMGCSAGLISIDLARDLLQVHPNSNAVVVSTEIITPNYYQGKERAMLLPNCLFRMGGAAILLSNRRSERWRAKYRLVHVVRTHKGADDKAYRCVFEEEDKEGNVGISLSKDLMAIAGEALKSNITTIGPLVLPASEQLLFLLTLIGRKIFNPKWKPYIPDFKQAFEHFCIHAGGRAVIDELQKNLQLSAEHVEASRMTLHRFGNTSSSSLWYEMSYIEAKGRMKKGDRVWQIAFGSGFKCNSAVWKCNRTIKTPKDGPWADCIHRYPVHIPEVVKL

SEQ ID NO: 625 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLYFMETSALEATNVENAFAEVLTQIYHIVSKKAMETSEEGNASAVPSKGEKIDVGKDVSAMKKGGCCSS

SEQ ID NO: 626 - protein, 222 aa, Gossypium hirsutum
ERVKMAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLYFMETSALEATNVENAFAEVLTQIYHIVSKKAMETSEEGNASAVPSKGEKIDVGKDVSAMKKGGCCSS

SEQ ID NO: 627 - protein, 162 aa, Gossypium hirsutum
ERVKMAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLYFMETSAL

SEQ ID NO: 628 - protein, 217 aa, Gossypium hirsutum
  misc_feature (156)..(156): Xaa can be any naturally occurring amino acid
  misc_feature (162)..(162): Xaa can be any naturally occurring amino acid
  misc_feature (164)..(164): Xaa can be any naturally occurring amino acid
  misc_feature (166)..(166): Xaa can be any naturally occurring amino acid
GWYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIIVMLIGNKSDLRHLVAVPTEDGKSFAEKESLYFMETSXLEATNXEXAXAEVLTQIYHIVSKKAMETADEGTASTVPSKGEKIDVGKDISAMKKGGCCSS

SEQ ID NO: 629 - protein, 291 aa, Gossypium hirsutum
MVGTEFCGEVIKRNKNLGLNEYKFLLKAIVSSGIGEQTYAPRIMFSGREESPKLEDGILEMEEFFHDSIEKVLSRAGISPQEIDLLVVNVSMLSTVPSLCSRIINHYKMRPDIKSFNLTGMGCSASLISLDIVRNVFKSYKNKFALLVTSESLSPNWYAGNDRSMILSNCLFRSGGCAVLLTNNKSLKHRAMFKLKCLVRTHHGAKDDSYGCCIQREDDKGRMGFHLSKSLPKAATRSFVDNLRVITPKILPVRELVRFMAVSLLKKWNVVRHGSSHKGASQGPIKAGVNF

SEQ ID NO: 630 - protein, 189 aa, Gossypium hirsutum
LGQVFTEIKGPLSLPTIFQHSSSEELPFFFSFSTAVDLDPYPRFQTSSKKMANAASGMAVHDDCKLKFLELKTKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 631 - protein, 167 aa, Gossypium hirsutum
RKSFLFFLSFSTAVDLDPYPRFQTSSKKMANAASGMAVHDDCKLKFLELKAKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 632 - protein, 272 aa, Gossypium hirsutum
MPKPFHLLVFFLVALCLCTSSNASSTTNEFLETECLKVPATEFIGSLKTTIDAIRKATSVVSQFGGFFHDFRLSNAISDCLDLLDSSADELSWTMSASQNPNAKDNSTGDLSSDLRTWLSAAMVNQQTCIDGFEGTNSMVKTVVSGSLNQITSLVRNLLIMVHPGPNSKSNGTRNGSQKGGGGGGHPGQNRFPVWFKREDRRLLQINGVTANVVVAADGSGNFTRIMDAVETAPDKSLNRYVIYIKKGLYKENVEIKKKKWNLMMIGDGMDV

SEQ ID NO: 633 - protein, 139 aa, Gossypium hirsutum
MANAASGMAVHDDCKLKFLELKAKRTYRYIVFKIEEKQKQVVVEKLGEPSQSYDDFTSSLPADECRYAVYDFDFVTAENCQKSRIFFIAWSPDTSRVRSKMIYASSKDRFKRELDGIQIELQATDPTEMGLDVIRSRAN

SEQ ID NO: 634 - protein, 508 aa, Gossypium hirsutum
GKVPPFRQNVAVITAGNPDIGKEMASPPAGKSPVGSPGGGGGSSSGNGEKKLNTGTVVGSAIGAVGGLSLLVLGICLYARKGKRTSKVRSPATVVIHPHHSGDQDGVKITVAGSSVTGGSETFSHSSSGPTDVHLVEAGNMVISIQVLRDVTNNFSEENVLGRGGFGTVYKGELHDGTKIAVKRMESSVVSEKGLAEFKSEIAVLTKVRHRHLVALLGYCLDGNERLLVYEYMPQGTLSRHLFNWKHEGLKPLEWTRRLTIALDVARGVEYLHGLAQQSFIHRDLKPSNILLGDDMRAKVADFGLVRLAPVDGKQSIETRLAGTFGYLAPEYAVTGRVTTKVDVFSFGVILMELISGRRALDETQPEESMHLVSWFRRMHMNKDTFRKAIDETIRLDEETLASVSTVTELAGHCCAREPYQRPDMSHAVNVLSSLAELWKPAEPDSDDIYGIDLELTLPQALKKWQAFEGNSSVDDSSSFLGSTDTTQTSIPCRPPGFADSFASADAR

SEQ ID NO: 635 - protein, 139 aa, Gossypium hirsutum; identical to SEQ ID NO: 148

SEQ ID NO: 636 - protein, 139 aa, Gossypium hirsutum
MANAASGMAVHDDCKLKFLELKAKRTYRFIVFKIEEKQKQVVVEKVGEPTDSYEAFTASLPADECRYAVYDFDFVTDENCQKSRIFFIAWSPDTSKVRSKMIYASSKDRFKRELDGIQVELQATDPSEMDLDVIRSRAN

SEQ ID NO: 637 - protein, 90 aa, Gossypium hirsutum
MKLLFLTLLLCSLLLCSSVFEPTMAQPRSPFCEGKCKGRCNKAAVWDRCFKYCGICCEECKCVPSGTFGNKHECPCYRDKVNNKGKPKCP

SEQ ID NO: 638 - protein, 408 aa, Gossypium hirsutum
MSRGELIIDDNQVKPASENWATEYQQQYNGGASWADEFVHDEVFRGPDHWANEFGAERLQQESVDDQWVNEFSKLHVDDWAEEFGRQVGEGALGDSSSDNWANSYDEFLNEQLAAKQRSDASRGVYVFSDMNPYVGHQNPLKEGQELFRKGLLSEAVLALEAEVMKNPENAEGWRLLGITHAENDDDQQAIAAMMRAQEADPTNLEVLLALGVSHTNELEQTAALKYLYGWLRHHPKYGTLAPPELANSLYYADVARLFNEAAQMSPEDADVHIVLGVLYNLSREYDKAIASFKTALKLKPNDYSLWNKLGATQANSVQSADAILAYQQALDLKPNYVRAWANMGISYANQGMYEESIRYYVRALAMNPKADNAWQYLRISLSCVSRNDMVEACDSRNLEILQKEFPL

SEQ ID NO: 639 - protein, 204 aa, Gossypium hirsutum
MSIFEYNGSALVAMVGKNCFAIASDRRLGVQLQTIATDFQRISKIHDRVFLGLSGLATDAQTLYQRLVFRHKLYQLREERDMKPETFANLVSALLYEKRFGPYFCQPVIAGLGDEDKPFICTMDSIGAKELAKDFVVAGTASESLYGACESMFKEDMEPEELFETVSQALLSSVDRDCLSGWGGHVYVVTPTEVKERILKGRMD

SEQ ID NO: 640 - protein, 189 aa, Gossypium hirsutum
MVTIPFFVLNILLFLSSSAATPKSGADHDLVRSSCVHASYPSLCFRTLSSYSGPANTPRELAQAAVKVSLSRARKVSNYLSTSVTGYNKRERVALSDCVEQIDESMEELSKTLGELKHLRGETFEFQMSNARTWVSAALTNEDTCLDGFEGVDGKVKSNVKRKITNVAKVTSNALYMINRLNESRGRHR

SEQ ID NO: 641 - protein, 498 aa, Gossypium hirsutum
MLLRGLSSLYKEITDTVRKEAATIMAVFPSPNDVMSILVQRVLEQRVTALLDKLLVKPSLVNPPPMEEGGLLLYLRMLAVAYEKTQELARELRAVGCGDLDVEGLTESLFSSHMDEYPEHEQASLGQLYQAKLDELRAENQNVSDSTGTIGRSKGASVASSHQQISVAVVTEFVRWNEEALTRCTLFSSQPATLAANVKAVFTCLLDQVSQYITDGLERARDSLTEAAAMRERFVLGTNLSRRVAAAAASAAEAAAAAGESSFRSFMVAVQRCGSSVAIVQQYFANSISRLLLPVDGAHAASCEEMATAMSSAEGAAYKGLQQCIETVMAEVERLLSAEQKATDYRSPDDGMAPDHRPTNACTRVVAYLSRVLEAAFTALEGLNKQAFLTELGNRLYKGLLNHWQKFTFNPSGGLRLKRDITEYGEFVRSFNAPSVDEKFELLGILANVFIVAPESLSSLFEGTPSIRKDAQRFIQLREDYKSAKLASRLSSLWSGSS

SEQ ID NO: 642 - protein, 94 aa, Gossypium hirsutum
KEKKMKLLFLTLLLCSLLLCSSVFEPTMAQPRSPFCEGKCKGRCNKAAVWDRCFKYCGICCEECKCVPSGTYGNKHECPCYRDKVNNKGKPKCP

SEQ ID NO: 643 - protein, 139 aa, Gossypium hirsutum
MANAASGMAVHDDCKLKFLELKAKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 644 - protein, 217 aa, Gossypium hirsutum
  misc_feature (12)..(12): Xaa can be any naturally occurring amino acid
  misc_feature (35)..(35): Xaa can be any naturally occurring amino acid
  misc_feature (63)..(63): Xaa can be any naturally occurring amino acid
MAAYRADDDYDXLFKVVLIGDSGVGKSNLLSRFTXNEFSLESKSTIGVEFATRSIRVDDKVVXAQIWDTAGQERYRAITSAYYRGAVGALLVYDVTRHVTFENVERWLKELRGHTDSNIVIMLVGNKADLRHLRAVSTDDAKAFAERENTFFMETSALESMNVENAFTEVLTQIHHVVSRKALEVGDDPAALPKGRTINVGSKDDVSAVKNAGCCSA

SEQ ID NO: 645 - protein, 355 aa, Gossypium hirsutum
PSHQSPKKHPRRNPWNSTSLLVSLSMSAFLLLSLLSLSHFFIFSSSSHHPPHNSPVYASESSQIRLACKSTRFPQPCESSLSRSSLLPPKSTSLQFIQSAISVSSDNLKTGQSMVKSILDSSKGNLNRSNAAAICLNILSNSDYRIRSTNDALARGKIKDARAWMSAAFCYQYDCWSALKYVNDTKLVGETMAFLDSLTQHSSNALSMMVAYDNYGEDIAAWVPPKTERDGFYENGSGGTELGFNGGLPSNLKTDVTVCKDGSGGCYKTVQEAVNTAPANAESTRRFVIYIKEGVYEETVRVPLEKKNVVFLGDGMGKTIITGALNAGMPGLTTYETATVGGLGDGFMASGLTIR

SEQ ID NO: 646 - protein, 90 aa, Gossypium hirsutum
  misc_feature (88)..(88): Xaa can be any naturally occurring amino acid
MGISYANQMKTGCVALVLCLNISVDPPDVIKISPCARIECWTDPFSTAPQKAVETIGKNLRDQYEKWQPKACSKVESDPTVDEMKKLXYT

SEQ ID NO: 647 - protein, 344 aa, Gossypium hirsutum
MAAALQLQTHPCFHGTCQLSPPPRPSVSFPSSSRSFPSSRRSLSAHVKAAASSLSTTTLQEGIAEFYDQSSGLWEDIWGDHMHHGFYDPDSNVSGSDHPAAQIRMIEESLRFAGITDDPAKQPKTIVDVGCGIGGSSRYLARKFGAECQGITLSPVQAGRANVLAKDEGLADKVSFQVADALKQPFPDGQFDLVWSMESGEHMPDKAKFVNELARVAAPGGTIIIVTWCHRDLGPSEEDLEPWEKKLLNRICNAYYLPEWCSTSDYVKLLQSLSLQDIKAADWSERVAPFWPAVIRSAFTWKGFISLLRSGLKAIKGALVMPLMIQGYQKGVIKFAIITCRKPE

SEQ ID NO: 648 - protein, 189 aa, Gossypium hirsutum
RNKRTFAPPHRFSTLVIGRAVLFLSLYFLISFSTAVDLDPYPRFQKSSKKMANAASGMAVHDDCKLKFQELKAKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 649 - protein, 166 aa, Gossypium hirsutum
  misc_feature (140)..(140): Xaa can be any naturally occurring amino acid
MWESICLTLVATAGNNIGKVLQKKGTVILPPLSFKLKVIRTYAVNKFWVIGFLMDISGALLMLRALSLAPVSVIQPVSGCGLAILSIFSHFYLQEVMNIVDWMGITLAGIGTIGVGAGGEEQESSAVSILQLPWLAFVVXIVFVGTPKWLASHLQASTERTRADRV

SEQ ID NO: 650 - protein, 139 aa, Gossypium hirsutum
MANAASGMAVHDDCKLKFLELKAKRTYRFIVFKIEEKQKQVVVEKVGKPTDSYEAFTASLPADECRYAVYDFDFVTDENCQKSRIFFIAWSPDTSKVRSKMIYASSKDRFKRELDGIQVELQATDPSEMDLDVIKSRAN

SEQ ID NO: 651 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEISFAEVLTQIYNVISKKAMETSDDGAASAVPSKGEKIDVGKDVSAMKKGGCCSS

SEQ ID NO: 652 - protein, 199 aa, Gossypium hirsutum
MATPPLSSPTYLTTNLGVGYAIVVALGFLLLLSTLLLASYICFRSSSPLPPRAISPNPISTPTASNSNGIVLPRIVFIGEEDHEHDEENVVVFGLDRAVINSYPKFRFSKEEVSTAVEVTGSSAGNTICSICLCEYRESEMLRMMPECRHCFHVTCIDAWLKLNGSCPVCRNSPLPTPISTPLSEVVPLSQYDADRRRW

SEQ ID NO: 653 - protein, 139 aa, Linum usitatissimum
MANAASGFAVDDDCKLKFLELKAKRTYRFVVFKIEEKQKQVIVEKLGEPGESYDDFAACLPADECRYAVFDFDFVTKENCQKSRIFFIAWSPDTARVRSKMIYASSKDRFKRELDGIQIELQATDPTEMGLDVFKSRAN

SEQ ID NO: 654 - protein, 139 aa, Vitis vinifera
MANAASGMAVHDDCKLKFLELKAKRTYRFIVFKIEEKQKQVVVEKVGEPAQSYEDFTASLPADECRYAVYDFDFVTEENCQKSRIFFIAWCPDSSRVRSKMIYASSKDRFKRELDGIQVELQATDPTEMGLDVIRSRAC

SEQ ID NO: 655 - protein, 143 aa, Vitis vinifera
MSFRGSNASSGMGVADHCKATYLELQRKKVHRYVIFKIDEKKKEVVVEKTGGPAESYDDFTASLPENDCRYAIYDFDFVTSENCQKSKIFFIAWSPSVSRIRAKMLYATSKDRFRRELEGIHYEIQATDPTEMDLEVLRERAN

SEQ ID NO: 656 - protein, 139 aa, Vitis vinifera
MANAASGMAVHDDCKLKFLELKAKRTYRFIVYKIEEKQKQVVVEKVGEPTQSYEDFTASLPADECRYAVYDFDFVTEENCQKSKIFFIAWSPDTSRVRSKMIYASSKDRFKRELDGIQVELQATDPTEMGLDVIRSRAS

SEQ ID NO: 657 - protein, 204 aa, Vitis vinifera
MSIFEYNGSALIAMVGKNCFAIASDRRFGVQLQTVATDFQKIYRIHDRVFLGLSGLATDAQTLYQRLVFRHKLYQLREERDMKPETFASLVSALLYEKRFGPYFCQPVIAGLGDEDKPFICTMDSIGAKELAKDFVVAGTASESLYGACEAMFKPDMEPEELFEIISQALLSSVDRDCLSGWGGHVYVVTPTEVKERILKGRMD

SEQ ID NO: 658 - protein, 139 aa, Vitis vinifera
MANAASGMAVHDDCKLKFLELKAKRTYRSIVFQIEEKQKQVIVEKVGEPTQSYEDFAASLPADECRYAVYDFDFVTEENCQKSRIFFIAWSPDTSRVRSKMIYASSKDRFKRELDGIQVELQATDPTEIGLDVIRSRAC

SEQ ID NO: 659 - protein, 418 aa, Vitis vinifera
VAYEKTQELARDLRAVGCGDLDVEGLTESLFLAHKDEYPEHEQASLRQLYQAKMEEMRAESQQLSESSGTIGRSRGASVASSHQQISVTVVTEFVRWNEEAISRCTLFSSQPTTLATNVKAVFTCLLDQVSQYITEGLERARDSLNEAAVLRERFMLGTSVSRRVAAAAASAAEAAAAAGESSFRSFMVAVQRCASSVAIVQQYFANSISRLLLPVDGAHASSCEEMATAMSSAETAAYKGLQKCIETVMAEVERLLSAEQKATDYRLPDDGIAPDHRPTNACTRVVAYLSRVLEAAFTALEGLNKQAFLTELGNHLHKGLLNHWQKFTFNPSGGLRLKRDITEYGEFVRSFNAPTVDEKFELLGIMANVFIVAPESLSSLFEGTPSIRKDAQRFIQLREDYKTAKLASRLSALWPSS

SEQ ID NO: 660 - protein, 218 aa, Vitis vinifera
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDNAFAEVLTQIYRIVSKKAMEAGDDGAASAVPSKGEKIDVGKDVSAMKRVGCCSN

SEQ ID NO: 661 - protein, 504 aa, Vitis vinifera
NESQGALGPGPHAADGWIAEFGQHRAEHGGPDAWAHSFVQQHGANGWASEFEQEQTQIAQMRGANISNLAAMEQTRMLAHTLAQNNDPKFQNSKFLQFVSKMSRGELIIDDNQVKPGASSSSGDWAGEFQQQYSGGLNWADQFVHDAGPERWVNEFTTEAKQRGSVDDPWVDEFSKLHIQDWVEEFGQQDEGAADNWATAYDEYLNEQEASKQQSDKSRGVYVFSDMNPYVGHPNPLKEGQELFRKGLLSEAVLALEAEVLKNPDNAEGWRLLGIAHAENDDDQQAIASMMRAQEVEPTNLEVLLALGVSHTNELEQAAALKYLYSWLRHHPKYGTLAPMEQSDSLYYADVVRLFNDAAQMSPEDADVHIVLGVLYNLSREYDKAIASFQTALKLKPRDYSLWNKLGATQANSVQSADAILAYQQALDLKPNYVRAWANMGISYANQGMHEDSIRYYVRALAMNPKADNAWQYLRISLSCASRNDMMEACDARNLDILQKEFPL

SEQ ID NO: 662 - protein, 218 aa, Vitis vinifera
MAGYRAEDDYDYLFKVVLIGDSGVGKSNLLSRFTKNEFNLESKSTIGVEFATRTLNVDGKVIKAQIWDTAGQERYRAITSAYYRGAVGALLVYDVTRHATFENVDRWLKELRNHTDPNIVVMLVGNKSDLRHLVAVSTEDGKTYAERESLYFMETSALEATNVENAFAEVLTQIYRIVSKKSVEGGDEGAASSVPAKGERINVKDDASALKRVGCCSG

SEQ ID NO: 663 - protein, 217 aa, Vitis vinifera
MASYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENNFFMETSALESMNVENAFTEVLTQIYRVVSRKALDIGDDPAALPKGQTINVGTKDDVSAVKKVGCCSA

SEQ ID NO: 664 - protein, 166 aa, Vitis vinifera
EGEEYLFKIVIIGDSAVGKSNLLSRYARNEFDLHSKATIGVEFQTQCVDIDGKEVKAQIWDTAGQERFRAVTSAYYRGAFGALLVYDISRRSTFESIARWLDELKIHCDTTVARMLVGNKCDLENIRDVSTEEGKNLAEAEGLFFMETSALDATNVKTAFEMVIRE

SEQ ID NO: 665 - protein, 178 aa, Ipomoea batatas
LSLYLWSRHRNCNLLHAFISTLDFLNRSIDLSAPSEVMANAASGMAVHDDCKLKFLELKAKRSFRFVVFKIEEKQKQVIVEKLGEPAQSYEDFAASLPADECRYAVYDFDFVTKENCQKSRIFFIAWSPDTARVRSKMIYASSKDRFKRELDGIQIELQATDPTEMGLDVIRSRAGCS

SEQ ID NO: 666 - protein, 217 aa, Ipomoea batatas
MGAYRADDDYDYLFKVVLIGDSGVGKSNLLSRFTRNEFSLESKSTIGVEFATRSIRVDEKVVKAQIWDTAGQERYRAITSAYYRGAVGALLVYDVTRHVTFENVERWLKELRDHTDSSIVIMLVGNKADLRHLRAVSTDDAKAFAERETTFFMETSALESMNVEDAFTEVLTQIYHVVSKRSLEAGDDQATLPKGQTISVGSKDDVSAVKKAGCCSA

SEQ ID NO: 667 - protein, 243 aa, Ipomoea batatas
PGIQISSGTKVERHTFLLLLLPIQNLSPASRFLSSVYLRMSIFEYNGSALVAMVGKNCFAIASDRRLGVQLQTVATDFERIYKIHGKLFLGLAGLATDVQTLYQRLVFRHKLYQLREERDMKPETFASLVSAILYEKRFGPYFCQPVIAGLGDEDKPFICTMDSIGAKELAKDFVVAGTASESLYGACEAMFKPDMEPEELFETISQALVASVDRDCLSGWGGHVYVVTPTEVTERILKGRMD

SEQ ID NO: 668 - protein, 218 aa, Ipomoea batatas
MMAGYRAEDDYDYLFKLVLIGDSGVGKSNLLSRFTRNEFSLESKSTIGVEFATRSLTVDAKVIKAQIWDTAGQERYRAITSAYYRGAVGALLVYDVTRHSTFESIERWLKELRDHTDPNIVVMLVGNKSDLRHLVAVSTEDGRSLAERESLYFMETSALEATNVENAFSEVLAQIYHVVSKKAMESGENGTASAVPSKGEKIDIGKDVSAVKKSGCCS

SEQ ID NO: 669 - protein, 139 aa, Ipomoea batatas
MANAASGMAVHDDCKLRFLELKAKRTHRFIVFKIEEKQKQVIVEKVGEPAQSYEDFTASLPADECRYAVYDFDFVTAENCQKSKIFFIAWSPDTSRVRSKMIYASSKDRFKRELDGIQVELQATDPTEMGMDVIRSRAN

SEQ ID NO: 670 - protein, 286 aa, Ipomoea batatas
SLYVTEGLERARDSLTEAAALRERFVLGTSVSRRVAAAAASAAEAAAAAGESSFKSFMVAVQRCGSSVAIVQQFFANSISRLLLPVDGAHAASCEEMAKAMSSAEGAAYKGLQQCIETVMAEVERLLSTEQKTTDFRSPDDGIGPDHRPTTACTRVVAYLSRVLESAFTGLDGLNKQAFLTELGNRLHKGLLNHWQKFTFNPSGGLRLKRDITEYGEFVRSFNAPSVDEKFELLGIMANVFIVAPESLSSLFEGTPSIRKDAQRFIELRDDYKSAKLASRFSSLFG

SEQ ID NO: 671 - protein, 163 aa, Ipomoea batatas
YFLRTPPNLSSVVLISDNKKMSSRGANASSGMGVAEHSKSTYMELQRKKVHRYVIFKIDEKKKEVVVEKTGGLAESYDDFTASLPETDCRYAVYDFDFVTSENCQKSKIFFIAWSPSVSRIRSKMLYATSKDRFRRELQGIHYEIQATEATEVDLEVLQERAN

SEQ ID NO: 672 - protein, 217 aa, Ipomoea batatas
MGEEEGEEYLFKVVVIGDSAVGKSNLLSRFARDEFDHNSKATIGVEFQTQVVEVDGKEVKAQVWDTAGQERFRAVTSAYYRGAVGALIVYDITRKTTFENIKRWLEELNTHCDTTVARMLVGNKCDLESIRDVSVEEGKLLAEEEGLFFIETSALDSTNVNTAFEIVIRDIYKNVSRKLLNSDSYKAELSVNRVSLANGADMSKQNKSSYACCSSSS

SEQ ID NO: 673 - protein, 139 aa, Ipomoea batatas
MANAASGMAVHDDCKLRFLELKAKRTHRFIVFKIEEKQKQVIVEKVGEPAQSYEDFTASLPTDECRYAVYDFDFVTAENCQKSKIFFIAWSPDTSRVRSKMIYASSKDRFKRELDGIQVELQATDPTEMGLDVIRSRAN

SEQ ID NO: 674 - protein, 139 aa, Lactuca sativa
MANAASGMAVHDDCKLKFMDLKAKRTFRFIIYKIEEKQKQVMVEKLGEPAETYDDFAACLPADECRYAVFDFDFMTAENVPKSRIFFIAWSPDTARVRSKMIYASSKDRFKRELDGIQIELQATDPTEVGLDVIRSRAN

SEQ ID NO: 675 - protein, 756 aa, Lactuca sativa
  misc_feature (245)..(245): Xaa can be any naturally occurring amino acid
MKEIRDGTKSNKISQPLVLDIEDFKGDYSFDALFGNLVNEVLPSFQEEDADSLEANGNINGNDALPNGRAGQGQGQGQLTPLFPEVDALLSMFKNSCSQLVEIRKQVDGKLFNLKKDVSAQDSKHRKTLGELEKGVDGLFDSFARLDSRISSVGQTAAKIGDHLQSADSQRETASQTMELIKYLMEFNSSPGDLMELSPLFSDDSRVAEAASIAQKLRSFAEEDIGRQGVTMQSVPGKCTASRGXEVAVGNLQEYCNELENRLLSRFDTASQKRELSTMAECAKILSQFNRGTSAMQHYVGLRPMFDVEVMNADTRLVLGDQDSLPSPSNVARALSSLYKEIIDTVRKEAATITAVFPSPNDVMSILVQRVMEDRVPKLLEKLLVKPSLVHPPPMGEGGLLLYLRMLAVGYEKTQELAKDLRSVGCGDLDIEGLTESLFIDHKDMYIEYEQASLRQLYKSKMEELLSESQLSGESTGSIGRSKGASISSSHQQISVTVVTEFVRWNEEAISRCTLFSPQPGNLATNVKTVFTCLLDQVSQYTTEGLERARDGLTEAAALRERFVLGTSVSRRVAAAAASAAEAAAAAGESSFRSFMVAVQRCGSSVAIVQQYFANSISRLLLPVDGAHAASCEEMATAMSSAEGAAYKGLQQCIETVMAEVERLLSAEQKATDYKSPDDGIVPDHRPTNACIRVVAYLSRVLEAAFTALEGLNKQAFLTELENRLHKGLSNHWQKYTFNPSGGLRLKRDITEYGDL

SEQ ID NO: 676 - protein, 139 aa, Lactuca sativa; identical to SEQ ID NO: 674

SEQ ID NO: 677 - protein, 230 aa, Lactuca sativa
  misc_feature (94)..(94): Xaa can be any naturally occurring amino acid
  misc_feature (97)..(97): Xaa can be any naturally occurring amino acid
GDRINNPHSATLTDIACVVVFILFGSMSIFEYNGSALVAMVGKNCFAIASDRRLGVQLQTIATDFQRIFKIHDKLFLGLSGLGSDAQTLHQRLXFRXKLYQLREERDMKPETFASLVSAVLYEKRFGPYFCQPVIAGLGEDDKPFICTMDSIGAKELAKDFVVAGTASESLYGACESMFKPDMDHEDLFETISQALLSSVDRDCLSGWGGHVYIVTPTEVTERILKGRMD

SEQ ID NO: 678 - protein, 204 aa, Lactuca sativa
MSIFEYNGSALVAMVGKNCFAIASDRRLGVQLQTIATDFQRIFKIHDKLFLGLSGLGSDAQTLHQRLVFRHKLYQLREERDMKPETFASLVSAVLYEKRFGPYFCQPVIAGLGDDDKPFICTMDSIGAKELAKDFVVAGTASESLYGACESMFKPDMEHEELFETISQALLSSVDRDCLSGWGGHVYLVTPTEVTERILKGRMD

SEQ ID NO: 679 - protein, 139 aa, Lactuca sativa
MANAASGMAVHDDCKLKFMDLKAKRTHRFIIYKIEEKQKQVMVEKLGEPAETYEDFVAFLPADECRYAVFDFDFMTAENVPKSRIFFIAWSPDTARVRSKMIYASSKDRFKRELDGIQIELQATDPTEVGLDVIRSRAN

SEQ ID NO: 680 - protein, 205 aa, Lactuca sativa
SMSIFEYNGSALVAMVGKNCFAIASDRRLGVQLQTVATDFQRIFKIHDKLFLGLSGLGSDAQTLHQRLVFRHKLYQLREERDMKPETFASLVSAVLYEKRFGPYFCQPVIAGLGDDDKPFICTMDSIGAKELAKDFVVAGTASESLYGACESMFKPDMEHEELFETISQALLSSVDRDCLSGWGGHVYLVTPTEVTERILKGRMD

SEQ ID NO: 681 - protein, 139 aa, Lactuca sativa; identical to SEQ ID NO: 679

SEQ ID NO: 682 - protein, 217 aa, Lactuca sativa
ILFHFTKSSSPLSMSIFEYNGSALVAMVGKNCFAIASDRRLGVQLQTIATDFQRIFKIHDKLFLGLSGLGSDAQTLHQRLVFRHKLYQLREERDMKPETFASLVSAVLYEKRFGPYFCQPVIAGLGDDDKPFICTMDSIGAKELAKDFVVAGTASESLYGACESMFKPDMEHEELFETISQALLSSVDRDCLSGWGGHVYLVTPTEVTERILKGRMD

SEQ ID NO: 683 - protein, 130 aa, Lotus Japonicus
AMVGKNCFAIASDRRLGVQLQTVATDFQRIFKVHDKLFIALSGLATDAQTLYQRLVFRHKLYQLREERDMKPETFASLVSALLYEKRFGPYFCQPVIAGLGDEDKPFICTMDCIGTKELAKDFVVAGSAS

SEQ ID NO: 684 - protein, 224 aa, Lotus Japonicus
  misc_feature (188)..(189): Xaa can be any naturally occurring amino acid
  misc_feature (211)..(212): Xaa can be any naturally occurring amino acid
EELVIIVLLLQSNQIKSNQTMSIFEYNGSALVAMVGKNCFAIASDRRLGVQLQTIATDFQRISKIHDKLFIGLSGLATDAQTLYQRLVFRHKLYQLREERDMKPETFASLVSSILYEKRFGPYFCQPVIAGLGDEDKPFICTMDCIGAKELAKDFVVAGSASESLYGACEAMFKPDMEPEELFETISXXLLSSVDRDCLSGWGGHVYVVTXXEVKERILKGRMD

SEQ ID NO: 685 - protein, 249 aa, Zea mays
EAQPGLHDKPTRPPPSPVATSPPILVADASTRTLLRDLAVAAALAMSIFEYNGSAVVAMVGKNCFAIASDRRLGVQLQTIATDFQRVFKVHDKLYIGLSGLATDAQTLYQRLVFRHKLYQLREERDMKPETFASLVSALLYEKRFGPYFCQPVIAGLGDDNVPFICTMDCLGAKELAKDFVVSGTASESLYGACESMYKPNMEPDELFETVSQALNSSIDRDCLSGWGGYVLIVTPTEVREHVIKSRMD

SEQ ID NO: 686 - protein, 204 aa, Zea mays
MSIFEYNGSAVVAMVGKNCFAIASDRRLGVQLQTIATDFRRVFKVHDKLYIGLSGLATDAQTLYQRLVFRHKLYQLMEERDMKPETFASLVSALLYEKRFGPYFCQPVIAGLGDNDEPFICTMDCIGAKELAKDFVVSGTASESLYGACESMYKPNMEPEELFETISQALQASVDRDCLSGWGGYVLVVTHTEVQERVLKGRMD

SEQ ID NO: 687 - protein, 415 aa, Zea mays
  misc_feature (67)..(67): Xaa can be any naturally occurring amino acid
  misc_feature (86)..(86): Xaa can be any naturally occurring amino acid
  misc_feature (88)..(88): Xaa can be any naturally occurring amino acid
SMSFQFVSKMSRGELIIEDNQVKEGSASQSSGWADEFQTPYIANANSWADQFAHEELSQGADKWVSXFSSQPNHGALNENWVDEFXKXNVTDEWAEEFSGGGFGESSADPWVDEFQEHLSSFKQSPGASRGVYVFSENNPYVGHPNPMQEGQELFRKGLLSEAVLALEAEVLKNPDNAEGWRLLGVTHAENDDDQQAIAAMMRALEANPTNLEVLLALGVSHTNELEQGEALRYLYRWLQNQPKYGGLVPLQSTDSPYGPDVVRLFNEAAQMSPEDADVHIVLGVLYNLSREYDKAIASFKTALQLKPQDYSLWNKLGATQANSIQSADAILAYQQALDLKPNYVRAWANMGISYANQGLYEDSIRYYVRAVAMNPKADNAWQYLRISLSNASRADMIAACDARNLDALQKEFPL

SEQ ID NO: 688 - protein, 222 aa, Zea mays
DASTRTLLRDLAVAAALAMSIFEYNGSAVVAMVGKNCFAIASDRRLGVQLQTIATDFQRVFKVHDKLYIGLSGLATDAQTLYQRLVFRHKLYQLREERDMKPETFASLVSALLYEKRFGPYFCQPVIAGLGDDNVPFICTMDCLGAKELAKDFVVSGTASESLYGACESMYKPNMEPDELFETVSQALNSSIDRDCLSGWGGYVLIVTPTEVREHVIKSRMD

SEQ ID NO: 689 - protein, 227 aa, Zea mays
PILVADASTRTLLRDLAVAAALAMSIFEYNGSAVVAMVGKNCFAIASDRRLGVQLQTIATDFQRVFKVHDKLYIGLSGLATDAQTLYQRLVFRHKLYQLREERDMKPETFASLVSALLYEKRFGPYFCQPVIAGLGDDNVPFICTMDCLGAKELAKDFVVSGTASESLYGACESMYKPNMEPDELFETVSQALNSSIDRDCLSGWGGYVLIVTPTEVREHVIKSRMD

SEQ ID NO: 690 - protein, 242 aa, Zea mays
RPHHSLDPKPDRHDEQRPPPERRGAMAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAASGPGKGEKINIKDDVSAVKKGGCCSS

SEQ ID NO: 691 - protein, 265 aa, Zea mays
  misc_feature (26)..(26): Xaa can be any naturally occurring amino acid
  misc_feature (130)..(130): Xaa can be any naturally occurring amino acid
RSLPCQCPLPFPFPPPSLFPHARRPXHSLDPKPDRHDEQRPPPERRGAMAAGYRAEDDYDYLFKVVLIGDSGVGKSNLLSRFTRNEFSLESKSTIGVEFATRSLQVDGKVVKAQIWDTAGQERYRAITSXYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAASGPGKGEKINIKDDVSAVKKGGCCSS

SEQ ID NO: 692 - protein, 139 aa, Zea mays; identical to SEQ ID NO: 566

SEQ ID NO: 693 - protein, 164 aa, Zea mays
KKGKEEKKNIRLLSVTFHQRFDPAAMANAASGMAVHDDCKLRFLELKAKRTHRFIVYKIEEKQKQVVVEKVGEPILSYEDFAASLPAEECRYAIYDFDFVTTENCQKSKIFFIAWCPDVAKVRSKMIYASSKDRFKRELDGIQVELQATDPTEMDLDVFKSRVN

SEQ ID NO: 694 - protein, 217 aa, Medicago sativa
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYRIVSKKAVEGAENGNASVPAKGEKIDLKNDVSALKRVGCCSS

SEQ ID NO: 695 - protein, 204 aa, Medicago sativa
MTIFKHNGSAVVAMVGKNCFAIASDRRLGVQLQTIATDFQRISKIHDKLYIGLSGLATDSQTLYQRLVFRHKLYQLREELDMKPETFASLVSAMQYEKRFGPYFCQPVIAGLGDDDKPFICTMDAIGAKELAKDFVVAGTASESLYGACESMFKPDMEAEELFETISQALLSSVDRDCLSGWGGHVYVVTPTEVKERILKGRMD

SEQ ID NO: 696 - protein, 139 aa, Medicago sativa
MANAASGMAVNDECKLKFLELKAKRTYRYIIYKIEEKQKQVVVDKVGDPANGYDDFTANLPADECRYAVYDFDFVTEENCQKSRIFFIAWCPDISRVRSKMIYASSKDRFKRELDGIQVELQATDPTEMDLDVFKSRVN

SEQ ID NO: 697 - protein, 204 aa, Medicago sativa
MSIFEYNGSALVAMVGKNCFAIASDRRLGVQLQTIATDFQRISKIHDKLFIGLSGLATDSQTLYQRLVFRHKLYQLREERDMKPETFASLVSSMQYEKRFGPYFCQPVIAGLGDDDKPFICTMDAIGAKELAKDFVVAGTASESLYGACESMFKPDMEAEELFETISQALLSSVDRDCLSGWGGHVYVVTPTEVKERILKGRMD

SEQ ID NO: 698 - protein, 166 aa, Medicago sativa
IGDSAVGKSNLLFRFARNEFDSGSRATIGVEFQTQMVEIDGKEVKAQIWDTAGQERFRAVTSAYYRGAFGALVVYDISRRGTFESIKRWLDELTTQNDSTVARMLVGNKCDLENIREVSIEEGKALAEEEGLFFMETSALDSTNVQTAFEIVIREIYNNISRKVLN

SEQ ID NO: 699 - protein, 139 aa, Prunus persica
  misc_feature (100)..(100): Xaa can be any naturally occurring amino acid
MANAASGFAVDDDCKLKFLELKAKRTYRFIVFKIEEEQKQVIVEKLGEPAESYENFTASLPADECRYAVYDFDFVTEENCQKSRIFFIAWSPDTSRVRSXMIYASSKDRFKRELDGIQVELQATDPTEIGLDVIKSRAS

SEQ ID NO: 700 - protein, 178 aa, Prunus persica
LAALSPPLGLSISLSLSLSLSLSPRFSRHFSLPRHFLGKMANAASGMAVHDECKLKFLELKAKRTYRFIVYKIEEKQKQVIVEKVGEPADSYEDFSASLPADECRYAVYDFDYVTEENCQKSRIIFIAWSPDTSKVRSKMIYASSKDRFKRELDGIQVELQATDPTEMGLDVIRSRAT

SEQ ID NO: 701 - protein, 204 aa, Prunus persica
MSIFEYNGSALIAMVGKNCFAIASDRRLGVQLQTVATDFKRINQVHDRLFIGLSGLATDAQTLYQRLMFRHKLYQLREERDMKPETFASLVSAILYEKRFGPYFCQPVIAGLSDEDRPFICTMDSIGAKELAKDFVVAGTASESLYGACEAMFKPDMEAEELFEIVSQALLSSVDRDCLSGWGGHVFVVTPTEVKERILKGRMD

SEQ ID NO: 702 - protein, 139 aa, Prunus persica
MANAASGMAVHDDCKLKFLELKAKRTYRSIVFKIEEKQKQVVVESVGEPTETYEQFAGKLPADECRYAVFDFDFLTPEGVQKSRIFFIAWSPDTSRVRSKMIYASSKDRFKRELDGIQIELQATDPTEIGLDVIKSRAS

SEQ ID NO: 703 - protein, 139 aa, Arachis hypogaea
MANAASGMAVHDDCKLKFLELKAKRTYRFIVFKIEEKQKQVVVEKLGEPAQGYDDFTASLPADECRYAVYDFDFVTEELCQKSRIFFIAWSPDTARVRSKMIYASSKERFKRELDGIQVELQATDPTEMGLDVFRSRTN

SEQ ID NO: 704 - protein, 204 aa, Arachis hypogaea
MSIFEYNGSALVAMVGKNCFAIASDRRLGVQLQTIATDFQRISKIHDKLFIGLSGLATDAQTLYQRLVFRHKLYQLREERDMKPETFASLVSALLYEKRFGPYFCQPVIAGLGDEDKPFICTMDSIGAKELAKDFVVAGTASESLYGACESMFKPDMEPEELFETISQALLSSVDRDCLSGWGGHVYVVTPTEVKERILKGRMD

SEQ ID NO: 705 - protein, 220 aa, Capsicum annuum
VVLFKTPKTHSFSSLAKQKNSIRFSPMSIFEYNGSALVAMVGKNCFAIASDRRLGVQLQTIATDFQRIYKIHDKLFIGLSGLATDTQTLHQRLVFRHKLYELREERNMKPETFASLVSAMLYEKRFGPYLCQPVIAGLGDDDKPFICTMDSIGAKELAKDFVVSGTASESLYGACEAMFKPDMGPEELFETISQALISSVDRDCLSGWGGHVYVVTPTEV

SEQ ID NO: 706 - protein, 139 aa, Capsicum annuum
MANAASGMAVHDDCKLRFLELKAKRTHRFVVFKIEEKQKQVVVEKIGEPTQSYEDFAACLPENECRYAVYDFDFVTAENCQKSRIFFIAWSPDTARVRSKMIYASSKDRFKRELDGIQVELQATDPTEMGLDVIKSRAN

SEQ ID NO: 707 - protein, 139 aa, Petunia x hybrida
MANAASGMAVHDDCKLRFLELKAKRTHRFIVYKIEEKQKQVVVEKIGEPTESYEDFAASLPENECRYAVYDFDFVTAENCQKSRIFFIAWCPDTARVRSKMIYASSKDRFKRELDGIQVELQACDPTEMGLDVIQSRAN

SEQ ID NO: 708 - protein, 174 aa, Petunia x hybrida
  misc_feature (3)..(4): Xaa can be any naturally occurring amino acid
  misc_feature (6)..(10): Xaa can be any naturally occurring amino acid
PLXXVXXXXXPTLSDPYIFSSNPPLSLSPGIMANAASGMAVHDDCKLKFLELKAKRTYRFIIYKIEEKQKQVVVEKLGEPTESYEDFTAGLPADECRYAVYDFDFMTKENHQKSRIFFIAWSPDTARVRSKMIYASSKDRFKRELDGIQVELQATDPTEMGLDVFRSRAGGIEC

SEQ ID NO: 709 - protein, 188 aa, Petunia x hybrida
LKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAKAFAEKESTFFMETSALESMNVDNAFTEVLTQIHRVVSRKALEVGDDPAALPKGQTINVG

SEQ ID NO: 710 - protein, 207 aa, Ananas comosus
AESYYTPSFTRLITLRSALLPHTAPPPSSRSHSLSLSLSLSLSPRVSLSSSSTRRLPFIFDRSPPRREMANAASGMAVNDECKLKFLELKAKRTHRFVIFKIEEKLKQIIVEKVGEPTLNYDDFTASLPADECRYAVYDFDFVTEENCQKSKIFFIAWSPDTSRVRSKMLYASSKDRFKRELDGIQVELQATDPTEMGLDVIRGRAN

SEQ ID NO: 711 - protein, 139 aa, Ananas comosus
MANAASGMAVDDDCKLKFLELKAKRTHRFIIFKIDEKLKQVVVEKLGEPSSSYEDFTANLPANECRYAIYDFDFVTEENVQKSRIFFIAWSPDISRVRSKMLYASSKDRFKRELDGIQVELQATDPSEMDLDVIRGRAN

SEQ ID NO: 712 - protein, 217 aa, Ananas comosus
MAGYRAEDDYDYLFKVVLIGDSGVGKSNLLSRFTRNEFSLESKSTIGVEFATRSLSVDGKVIKAQIWDTAGQERYRAITSAYYRGAVGALLVYDVTRHSTFENAERWLRELRDHTDPNIVVMLVGNKSDLRHLVAVSAEEGKAFAERESLYFMETSALESTNVENAFAEVLTQIYHIVSKKAVETGDDGASAVPSKGEKINVKDDVSALKRVGCCST

SEQ ID NO: 713 - protein, 139 aa, Ananas comosus
MANAASGMAVNDDCKLKFLDLKAKRTYRFIIYKIEEKLKQVVVEKLGEPTLGYEDFTASLPANECRYAVYDFDFVTEENCQKSKIFFIAWSPDTSRVRSKMLYASSKDRFKRELDGIQVELQATDPTEMGLDVIRGRAN

SEQ ID NO: 714 - protein, 204 aa, Pinus pinea
MSIFEYNGSALVAMVGKNCFAIASDRRLGVQLQTIATDFQRIFKIHDKLYVGLSGLATDVQTLYQRFAFRHKLYQLREERNMRPETFASLVSALLYEKRFGPYFCQPVIAGLGEDDKPFICTMDSIGAKELAKDFVVAGTAAESLYGACESMYKPDMEPEELFETISQALLSSIDRDCLSGWGGHVYVVSPNQVTERTLKGRMD

SEQ ID NO: 715 - protein, 204 aa, Pinus pinea
MSIFEYNGSALVAMVGKNCFAIASDRRLGVQLQTIATDFQRIFKIHDKLYVGLSGLATDVQTLYQRFAFRHKLYQLREERNMRPETFASLVSALLYEKRFGPYFCQPVIAGLGEDDKPFICTMDSIGAKELAKDFVVAGTAAESLYGACESMYKPDMEPEELFETISQALLSSIDRDCLSGWGGHVYVVSPNQVIERTLKGRMD

SEQ ID NO: 716 - protein, 139 aa, Populus tremula x Populus alba
MANAASGMAVHDDCKLKFLELKAKRTYRFIVYKIEEKQKQVIVEKLGEPAQSYEDFTASLPADECRFAVYDFDFVTAENVQKSRIFFIAWSPDTSRVRSKMIYASSKDRFKRELDGIQVELQATDPTEMGLDVIRSRAS

SEQ ID NO: 717 - protein, 139 aa, Populus tremula x Populus alba
MANAASGMAVHDDCKLKFLELKAKRTYRFIVYKIEEEQKQVIVEKLGEPAQSYEDFTASLPADECRYAVYDFDFVTEENVQKSRIFFIAWCPDTSRVRSKMIYASSKDRFKRELDGIQVELQATDPTEMGLDVIRSRAS

SEQ ID NO: 718 - protein, 139 aa, Populus tremula x Populus alba
MANAASGMAVHDDCKLKFLELKAKRTYRFIVYKIEEEQKQVIVEKLGEPAQSYEDFTASLPADECRYAVYDFDFVTEENVQKSRIFFIAWSPDTSRVRSKMIYASSKDRFKRELDGIQVELQATDPTEMGLDVIRSRAS

SEQ ID NO: 719 - protein, 139 aa, Populus tremula x Populus alba
MANAASGMAVHDDCKLKFLELKAKRTYRFIVYKIEEKQKQVIVEKLGEPAQSYEDFTASLPADECRYAVYDFDFVTEENVQKSRIFFIAWSPDTSRVRSKMIYASSKDRFKRELDGIQVELQATDPTEMGLDVIKSRAS

SEQ ID NO: 720 - protein, 139 aa, Populus tremula x Populus alba
MANAASGMAVHDDCKLKFLELKAKRTYRSIVFKIEEKLKQVIVEKLGEPAQSYEDFTASIPADECRYAVYDFDFMTAENVQKSRIFFIAWSPDTSRVRSKMIYASSKDRFKRELDGIQIELQATDPTEMGLDVIRSRAS

SEQ ID NO: 721 - protein, 234 aa, Populus tremula x Populus alba
TAKEILKGLFHSLLLLFTLSLSFFFALHFPMSIFEYNGSAIVAMVGKNCFAIASDRRLGVNLQTVATDFQRIYKIHDKVFVGLSGLGTDAQTLYQRLVFRHKLYQLREERDMKPETFASLVSAILYEKRFGPYFCQPVIAGLGDDDKPFICTMDFIGAKELAKDFVVAGSASESLYGACEALFKPDMEPEELFEVVSQALLASVDRDCLSGWGGHIYIVTPDEIREKILKGRMD

SEQ ID NO: 722 - protein, 218 aa, Populus tremula x Populus alba
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDSAFAEVLTQIYRIVSKKAMETGDEAAASAVPSKGEKIDVSKDVSAMKRVGCCSS

SEQ ID NO: 723 - protein, 190 aa, Populus tremula x Populus alba
KLRLFSSPTKKKRSRKKRDYLYHVQPPHSLLALDSLISFAYVIFFYQNREKMANAASGMAVHDDCKLKFLELKAKRTHRFIVFKIEEKQKQVIVEKLGKPTDSYEDFTASLPANECRYAVYDFDYVTDENCQKSRIVFVAWSPDTSRVRSKMIYASSKDRFKRELDGIQIELQATDPTEMGLDVIRSRSY

SEQ ID NO: 724 - protein, 186 aa, Populus tremula x Populus alba
REKKEKEEKSIFITSSTSPPPPSSLLALDFLSLVSLPLFLSNQKEKKMANAASGMAVHDDCKLRFLDLKAKRTYRFIVFKIEEKQKQVIVEKLGEPADSYENFSASLPADECRYAVYDFDYVTEENCQKSRIVFIAWCPDTARVRSKMIYASSKDRFKRELDGIQIELQATDPTEMGLDVIRSRSN

SEQ ID NO: 725 - protein, 218 aa, Populus tremula x Populus alba
MAGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDNAFAEVLNQIYSIVSKKAMETGDNAAASAVPSKGEKIDVNKDVSAMKRVGCCSS

SEQ ID NO: 726 - protein, 224 aa, Populus tremula x Populus alba
KEKKTHQMGAYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDANNVIMLVGNKADLRHLRAVATEDAKGFAERESTFFMETSALESMNVENAFTEVLTQIYRVVSRKALDVGDDSTYLPKGQTINVGSRDDVSAVKKAGCCSS

SEQ ID NO: 727 - protein, 330 aa, Populus tremula x Populus alba
TVVTEFVRWNEEAISRCTLFSSLPATLAANVKAVFTCLLDQVGQYITEGLERARDGLTEAATLRERFVLGTSVSRRVAAAAASAAEAAAAAGESSFRSFMVAVQRCGSSVAIVQQCFANSISRLLLPVDGAHAASCEEMATAMSTAEAAAYKGLQQCIETVMAEVERLLPAEQKATDYRSPDDGMAPDHRPTNACTKVVAYLSRVLEAAFTALEGLNKQAFLTELGNRLHKGLLNHWQKFTFNPSGGLRLKRDITEYGEFVRSFNAPSVDEKFELLGIMANVFIVAPESLSTLFEGTPSIRKDAQRFIQLREDYKSAKLASRLGSLVDKL

SEQ ID NO: 728 - protein, 254 aa, Populus tremula x Populus alba
LLASSPSQPAFYSTWNFLYRNSKRKTQRSPKYSFILSSSSPLSPPILSFPMSIFEYNGSAIVAMVGKNCFAIASDRRLGVNLQTVATDFQRIYKIHDKLFVGLSGLGTDAQTLYQRLVFRHKMYQLREERDMKPETFANLVSAVLYEKRFGPYFCQPVIAGLDDDDKPFICTMDFIGAKELAKDFVVAGSASESLYGACEAFFKPDMEPDELFEVVSQALLASVDRDCLSGWGGHIYIVTPDDIKEKILKGRMD

SEQ ID NO: 729 - protein, 121 aa, Solanum tuberosum
  misc_feature (115)..(115): Xaa can be any naturally occurring amino acid
THRFIVFKIEEKQKQVVVEKVGEPTQSYEDFAESLPADECRYAVYDFDFVTEENCQKSRIFFIAWSPDTARVRSKMIYASSKDRFKRELDGIQIELQATDPTEMGLDVIKSRANXVWMIRY

SEQ ID NO: 730 - protein, 190 aa, Solanum tuberosum
MMKTLLLPLFLLHLISSIITTSSSVSDIVRSSCVHASYPTICIRTLSSYSGSAINTPQDLAQAAVKITLSRAHKASGFLSQVKVGSKREKGALSDCIEQMGDSMEELSKSLSELKHLRRGNAFKWQMSNLETWVSAALTNEDTCLDGFKEIDGKIRSDVKRKITNVARVTSNALYLINRLDDSRNKIPHP

SEQ ID NO: 731 - protein, 154 aa, Solanum tuberosum
LEPFFNLFEFSNTIKMANAASGMAVHDDCKLRFLELKAKRTHRFIVFKIEEKQKQVVVEKVGEPAQSYEDFTACLPDNECRYAVYDFDFVTAENCQKSRIFFIAWSPDTARVRSKMIYASTKERFKREVDGIQVELQATDPTEMGLDVIKSRAN

SEQ ID NO: 732 - protein, 196 aa, Solanum tuberosum
MEDDVEMAAGENGAGELDDMKKRLKEMEDEAVALREMQAKVEKEMGSVQDPAAAAANQANKEEVDSRSVFVGNVDYSCTPEEVQQHFQACGTVNRVTIRTNKFGQPKGYAYVEFVEPEAVQEALLLNESELHGRQLKVSAKRTNVPGMKPYRARRPNPYMGFRGRTPFMPAPYFFPPFGYGKIPRARAPMRYSPYF

SEQ ID NO: 733 - protein, 181 aa, Solanum tuberosum
MEDDVEMAAGENGAGELDDMKKRLKEMEDEAVALREMQAKVEKEMGSVQDPAAAAANQANKEEVDSRSVFVGNVDYSCTPEEVQQHFQACGTVNRVTIRTNKFGQPKGYAYVEFVEPEAVQEALLLNESELHGRQLKVSAKRTNVPGMKPYRARRPNPYMGFRGRTPFMPAPYFFPPFGYG

SEQ ID NO: 734 - protein, 234 aa, Solanum tuberosum
GSSRHKKLSLSSLAKAFCKKLRFVSLNHSPMSIFEYNGSALVAMVGKNCFAIASDRRFGVQLQTIATDFQRIYKIHEKLFIGLSGLATDTQTLQQRLMFRHKLYELREDRDMKPETFASLVSAMLYEKRFGPYLCQPVIAGLGDDDKPFICTMDSIGAKELAKDFVVSGTASESLYGACEAMYKPDMGPEELFETISQALLSSVDRDCLSGWGGHVYVVTPTEVTERILKGRMD

SEQ ID NO: 735 - protein, 257 aa, Solanum tuberosum
PFLHLLLKSFHLSSSSFSLSIHTYIIYIIYIYKRIERPPVMGAYRSDDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAQAFAEKESTFFMETSALESMNVESAFTEVLTQIHRVVSRKALEVGDDPAALPKGQTINVGGKDDVSEVKKAGCCSA

SEQ ID NO: 736 - protein, 250 aa, Solanum tuberosum
PLSASSSQILPSLFFFIFSLYTYIYQRIERPPVMGAYRSDDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAQAFAEKESTFFMETSALESMNVESAFTEVLTQIHRVVSRKALEVGDDPAALPKGQTINVGGKDDVSEVKKAGCCSA

SEQ ID NO: 737 - protein, 170 aa, Solanum tuberosum
PKYQFYRSPKFSPFFLIFFQSVLSPSIMANAASGMAVHDDCKLKFLELKAKRTYRFIIYKIEEKQKQVVVEKLGEPTESYEDFAAGLPADECRYAVYDFDFMTEENCQKSRIFFIAWSPDTARVRSKMIYASSKDRFKRELDGFQVELQATDPTEMGLDVFRSRAGGIEC

SEQ ID NO: 738 - protein, 149 aa, Solanum tuberosum
NLFEFSNTIKMANAASGMAVHDDCKLRFLELKAKRTHRFIVFKIEEKQKQVVVEKVGEPAQSYEDFTACLPDNECRYAVYDFDFVTAENCQKSRIFFIAWSPDTARVRSKMIYASTKERFKRELDGIQVELQATDPTEMGLDVIKSRAN

SEQ ID NO: 739 - protein, 156 aa, Solanum tuberosum
MAGSEFPHAYAETPSINNSDTLFQRRRRCFCFPSFRSPNQLTKYVKLDWWHRLRSGAVTEGSVWAKGINALKKLREWSEIVAGPRWKTFIRRFHRNKSGNRNAKFQYDPLSYSLNFDEGRRNNGEEEEELVLRNFSTRYASIPASSNFGKDGPSFV

SEQ ID NO: 740 - protein, 217 aa, Oryza sativa
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRSVEAGDDAGSGPGKGEKINIKDDVSAVKKGGCCSG

SEQ ID NO: 741 - protein, 239 aa, Oryza sativa
LFFFSRSPETNRNRRAPPPPPPRRPPQPSSPSAPVMSIFEYNGSAVVAMVGKNCFAIASDRRLGVQLQTVATDFQRVFKIHDKLYIGLSGLATDAQTLYQRLVFRHKLYQLREERDMKPQAFASLVSALLYEKRFGPYFCQPVIAGLGDNDEPFICTMDCIGAKELAKDFVVSGTASESLYGACESMYKPSMEPEELFETISQALQASVDRDCLSGWGGYVLLVTPTEVQERVIKGRMD

SEQ ID NO: 742 - protein, 197 aa, Oryza sativa
GEQASVHSTRLPNTNTTTTSHTHTKRRAPEREKGSIDARALCLDSFVAGESVPFAPPAMANAASGMAVDDECKLKFLELKAKRTYRFIIYKIDEKKKMVVVEKVGEPVLNYDDFAASLPANECRYAIFDYDFVTEENCQKSKIFFIAWSPDTSRVRSKMIYASSKDRFKRELDGIQVELQATDPTEVGLDVIRGRAN

SEQ ID NO: 743 - protein, 235 aa, Oryza sativa
FSSSTSNLDACIRIRLRLRLRLRRELAAAPAMSIFEYNGSAVVAMVGKNCFAIASDRRLGVQLQTVATDFQRVFKIHDKLYIGLSGLATDAQTLYQRLVFRHKLYQLREERDMKPQTFASLVSALLYEKRFGPYFCQPVIAGLGEDNEPFICTMDCIGAKELAKDFVVSGTASESLYGACESMYKPNMEPEELFETISQALQSSVDRDCLSGWGGFVLLVTPTEVKECVIKGRMD

SEQ ID NO: 744 - protein, 183 aa, Rosa hybrid cultivar
  misc_feature (99)..(99): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(105): Xaa can be any naturally occurring amino acid
  misc_feature (117)..(117): Xaa can be any naturally occurring amino acid
  misc_feature (140)..(140): Xaa can be any naturally occurring amino acid
  misc_feature (150)..(150): Xaa can be any naturally occurring amino acid
SGGVSSLSHRLSLSLSLIDHTPPFSLTLKPIHPFSSWPQSSATTMANAASGFAVDDDCKLKFLDLKAKRTYRFIVFKIEEKQKQVIVEKLGEPAQSYEXFXAXLXADECRYAVYDFXFVTAENCQKSRIFFIAWSPDTSXVRNKMIYASXKDRFKRELDGIQIELQATDPTEMDLDVIRSRAS

SEQ ID NO: 745 - protein, 239 aa, Rosa hybrid cultivar
  misc_feature (144)..(144): Xaa can be any naturally occurring amino acid
EIFSRTYLLSCVTVRNKKKKKKPMAGYRAEDDYDYLFKVVLIGDSGVGKSNLLSRFTRNEFSLESKSTIGVEFATRSLDVDGKVIKAQIWDTAGQERYRAITSAYYRGAVGALLVYDVTRNSTFESVERWLRELRDHTDPNIVXMLVGNKSDLRHLVAVSTEDGKSFAERESLYFMETSALEATNVDNAFAEVLTQIFRIVSKKTMEANNDAAAVPSQGEKIDVSKDVSAVKKGGCCSS

SEQ ID NO: 746 - protein, 151 aa, Rosa hybrid cultivar
DPKIPCNIFLCKMANAASGMAVHDDCKLKFLDLKAKRTYRFIVYKIEEEQKQVGVEKLGEPSQSYQDFSACLPADECRYAVYDFDYVTEENCQKSRIIFIAWSPDISRVRSKMIYASSKDRFKRELDGIQVELQATDPIVFFFDVIRSRAN

SEQ ID NO: 747 - protein, 148 aa, Sesamum indicum
PRSLPEAPEMANAASGMAVHDDCKLRFLELKAKRTYRFIIFKIEEKQKQVVVEKVGEPTQSYDDFTASLPADECRYAVYDFDFVTAENCQKSRIFFIAWSPDTSRIRNKMIYASSKDRFKRELDGIQVELQATDPTEMGLDVIKSPAN

SEQ ID NO: 748 - protein, 204 aa, Sorghum bicolor
MSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDDDVPFICTMDCIGAKELAKDFVVSGTASESLYGACESMYKPNMEPDELFETISQALNSSVDRDCLSGWGGYVLIVTPTEVREHVIKSRMD

SEQ ID NO: 749 - protein, 245 aa, Sorghum bicolor
HEAFLFFFSLSAGGKQPESPPSPFSPSPLLPPLPQATSAPTMSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDNNEPFICTMDCIGAKELAKDFVVSGTASESLYGACESMYKPNMEPEELFETISQALQASVDRDCLSGWGGYVLIVTPTEVQERVLKGRMD

SEQ ID NO: 750 - protein, 215 aa, Sorghum bicolor
MMRALEANPTNLEILLALGVSHTNELEQGEALRYLSRWLQNHPKYGGLVPPQSTDSPYGPDVVRLFNEAAQMSPEDADVHIVLGVLYNLSREYDKAIASFKTALQLKPQDYSLWNKLGATQANSIQSADAILAYQQALDLKPNYVRAWANMGISYANQGLYEDSIRYYVRAVAMNPKADNAWQYLRISLSNASRADMIAACDARNLDALQKEFPL

SEQ ID NO: 751 - protein, 217 aa, Glycine max
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALEATNVENAFAEVLTQIYHIVSKKAVEVAENGTTSVPAKGEKIDLKNDVSALKRVGCCSS

SEQ ID NO: 752 - protein, 177 aa, Glycine max
PKFLILPFPLRTLDHSHALLYPLLHRRSLQRSQQHRHPMANAASGMAVHDDCKLRFLELKTKRTHRFIVFKIEEQQKQVIVEKLGEPAQGYEDFTASLPADECRYAVYDFEYLTEGNVPKSRIFFIAWSPDTSRVRSKMIYASSKDRFKRELDGIQVELQATDPTEMGLDVFKSRAN

SEQ ID NO: 753 - protein, 204 aa, Glycine max
MSIFEYNGSAVVAMVGKNCFAIASDRRLGVQLQTIATDFQRISKIHDKLFIALSGLATDAQTLYQRLVFRHKLYQLREERDMKPETFASLVSALLYEKRFGPYFCQPVIAGLGDEDKPFICTMDCLGAKELAKDFVVSGTASESLYGACEAMFKPDMEPEELFETISQALLSSVDRDCLSGWGGHVYVVTPTEVKERILKGRMD

SEQ ID NO: 754 - protein, 220 aa, Glycine max
NSAPAQTKALQLQIQRMSIFEYNGSAVVAMVGKNCFAIASDRRLGVQLQTIATDFQRISKIHDKLFIALSGLATDAQTLYQRLVFRHKLYQLREERDMKPETFASLVSALLYEKRFGPYFCQPVIAGLGDEDKPFICTMDCIGAKELAKDFVVSGTASESLYGACEAMFKPDMEPEELFETISQALLSSVDRDCLSGWGGHVYVVTPNEVKERILKGRMD

SEQ ID NO: 755 - protein, 498 aa, Glycine max
  misc_feature (72)..(72): Xaa can be any naturally occurring amino acid
  misc_feature (79)..(79): Xaa can be any naturally occurring amino acid
  misc_feature (82)..(82): Xaa can be any naturally occurring amino acid
  misc_feature (86)..(86): Xaa can be any naturally occurring amino acid
  misc_feature (100)..(100): Xaa can be any naturally occurring amino acid
  misc_feature (103)..(103): Xaa can be any naturally occurring amino acid
  misc_feature (105)..(105): Xaa can be any naturally occurring amino acid
NNMPPILPDFSNSVKLKYVKLGYQYLVNHILTLTLIPMMIAIFMEILRLGPEEILNLWHSLHLDLVQILCSXFLIIFIXTVXFMSXPRTIYLVDYACFKXPVXCXVPFATFMEHSRLILKDNPKSVEFQMRILERSGLGEETCLPPAIHYIPPKPTMEAARGEAELVIFSAMDSLFNKTGLKPKDIDILIVNCSLFSPTPSLSAMVINKYKLRSNIKSFNLSGMGCSAGLISVDLARDLLQVHPNSNAVVVSTEIITPNYYQGKERAMLLPNCLFRMGGAAILLSNRTSERRRAKYRLVHVVRTHKGADDKAYRCVFEEEDREGKVGISLQKDLMAIAGEALKSNITTMGPLVLPASEQLLFLLTLIGRKIFNPKWKPYIPDFKQAFEHFCIHAGGRAVIDELQKNLQLSTEHVEASRMTLHRFGNTSSSSLWYELNYIESKGRMKKGDRVWQIAFGSGFKCNSAVWKCNRSIKTPVDGPWADCIDRYPVDIPEIVKL

SEQ ID NO: 756 - protein, 217 aa, Glycine max
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVSTDDAKAFAERENTFFMETSALESLNVDNAFTEVLTQIYRVVSRKTLEIGDDPAALPKGQTINVGSRDDVSAVKKSGCCSA

SEQ ID NO: 757 - protein, 178 aa, Glycine max
  misc_feature (2)..(2): Xaa can be any naturally occurring amino acid
VXVASFLPQPNLRLRPQQLLLQDRCQRYFPFLPFILEKKMANAASGMAVHDECKLKFLELKAKRTYRYIVFKIEEKSKQVIVEKLGDPANGYDEFAASLPADECRYAVYDFDFVTEENCQKSRIFFIAWSPDTSRVRSKMIYASSKDRFKRELDGIQIELQATDPTEMGLDVFKSRAN

SEQ ID NO: 758 - protein, 204 aa, Glycine max
MSIFEYNGSALVAMVGKNCFAIASDRRLGVQLQTIATDFQRISKIHDKLFIGLSGLATDAQTLYQRLLFRHKLYQLREERDMKPQTFASLVSAILYEKRFGPYFCQPVIAGLGDDDKPFICTMDAIGAKELAKDFVVAGTASESLYGACESMFKPDMEPEELFETISQALLSSVDRDCLSGWGGHVYVVTPTEVKERILKGRMD

SEQ ID NO: 759 - protein, 178 aa, Glycine max
IPKISHSPFPLRTLDHSHALLYSLLHRRSLEQPQHHLHHMANAASGMAVHDDCKLRFLELKAKRTHRFIVFKIEEQQKQVIVEKLGEPAQGYEDFTASLPADECRYAVYDFEYLTEGNVPKSRIFFIAWSPDTSRVRSKMIYASSKDRFKRELDGIQVELQATDPTEMGLDVFKSRAN

SEQ ID NO: 760 - protein, 245 aa, Glycine max
FLPFLLFTTCLFPFSFQNNRTTEQKAPPMAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALEATNVENAFAEVLTQIYRIVSKKAVEGAENGTASVPAKGEKIDLKNDVSALKRVGCCSS

SEQ ID NO: 761 - protein, 139 aa, Glycine max
MANAASGMAVHDDCKLKFLELKAKRTYRFIVFKIEEKQKQVIVEKLGEPANGYDDFAASLPADECRYAVYDFDFVTEENCQKSRIFFIAWSPDTSRVRSKMIYASSKDRFKRELDGIQIELQATDPTEMGLDVFKSRAN

SEQ ID NO: 762 - protein, 204 aa, Picea sitchensis; identical to SEQ ID NO: 715

SEQ ID NO: 763 - protein, 238 aa, Saccharum officinarum
LSAGAGGNQPESPPSPFSPSPLLPPLPLSTSAPTMSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDNDEPFICTMDCIGAKELAKDFVVSGTASESLYGACESMYKPNMEPDELFETISQALQASVDRDCLSGWGGYVLIVTPTEVQERVLKGRMD

SEQ ID NO: 764 - protein, 204 aa, Saccharum officinarum
MSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDDDVPFICTMDCIGAKELAKDFVVSGTASESLYGACESMYKPNMEPDELFETISQALSSSVDRDCLSGWGGYVLIVTPTEVREHVIKTRMD

SEQ ID NO: 765 - protein, 242 aa, Saccharum officinarum
SLSPPKTRSARREQREGPGAARSGAMAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAASGPGKGEKINIKDDVSAVKKGGCCSS

SEQ ID NO: 766 - protein, 204 aa, Helianthus annuus
MSIFEYNGSALVAMVGKNCFAIASDRRLGVQLQTIATDFQRIFKIHDKLFLGLSGLGSDAQTLHQRLVFRHKLYQLREERDMKPETFASLVSAMLYEKRFGPYFCQPVIAGLGEDDKPFICTMDSIGAKELAKDFVVAGTASESLYGACESMFKPDMDHEELFETISQALISSVDRDCLSGWGGHVYIVTPTEVTERILKGRMD

SEQ ID NO: 767 - protein, 139 aa, Helianthus annuus
MANAASGMAVHDECKLKFLELKAKRTFRYIIFKIEEKQKEVIVEKVGEPTQSHEDFAASLPAGECRYAVFDYDFVTAENCQKSRIFFIAWSPDTAKVRNKMIYASSKDRFKRELDGIQVELQATDPTEMDLDVFKSRAN

SEQ ID NO: 768 - protein, 204 aa, Helianthus annuus
MSIFEYNGSALVAMVGKNCFAIASDRRLGVQLQTIATDFQRIFKIHDKLFLGLSGLGSDAQTLHQRLVFRHKLYQLREERDMKPETFASLVSAMLYEKRFGPYFCQPVIAGLGEDDKPFICTMDSIGAKELAKDFVVAGTASESLYGACESMFKPDMDHEELFETISQALISSIDRDCLSGWGGHVYIVTPTEVTERILKGRMD

SEQ ID NO: 769 - protein, 139 aa, Thellungiella halophila
MANAASGMAVHDDCKLKFLELKAKRTYRFIVYKIEEQQKQVIVEKVGEPGQSHDDFAASLPADECRYAIFDFDFVTAENCQKSKIFFVAWSPDTARVRSKMIYASSKDRFKRELDGIQVELQATDPTEMDLDVFKSRAN

SEQ ID NO: 770 - protein, 215 aa, Nicotiana tabacum
LFLASYVNILSRKREGTAMEDDVEMAAADNRAAVEMDEMKKRLKEMEDESAALLEMQAKVEKEMGSVQDPAAAAATQANREEVDGRSVFVGNVDYSCTPEEVQQHFQACGTVNRVTIRTNKFGQPKGYAYVEFLEAEAVQEALLLNESELHGRQIKVSAKRTNVPGMKQFRARRPSPYMGFRGQTPFMPAPYFYSPYGYGKVPRARAPMRYSPYF

SEQ ID NO: 771 - protein, 227 aa, Nicotiana tabacum
LHRFSDQKPFRNIVRFVVLFSPRMSIFEYNGSALVAMVGKNCFAIASDRRLGVQLQTIATDFQRIFRIHDKVFIGLSGLGTDVQTLYQRLVFRHKLYQLREERDMKPETFASLVSALLYEKRFGPYFCQPVIAGLGDDDKPFICTMDSIGAKELAKDFVVAGTASESLYGACEAMFKPDMGPEELFETISQALIASVDRDCLSGWGGHVYVVTPTEVTEKILKGRMD

SEQ ID NO: 772 - protein, 174 aa, Nicotiana tabacum
FVSGLIIDKKRQLYRSPKFSPLFIRSLSFKIMANAASGMAVHDDCKLKFLELKAKRTHRFIIYKIEEKQKQVVVEKLGEPTESYEDFTAGLPADECRYAVYDFDFTTEENVQKSRIFFIAWSPDTARVRSKMIYASSKDRFKRELDGFQVELQATDPTEMGLDVFRSRVGGIEC

SEQ ID NO: 773 - protein, 139 aa, Nicotiana tabacum
MANAASGMAVHDDCKLRFLELKAKRTHRFIVFKIEEKQKQVVVEKVGEPTESYEDFAASLPDNECRYAVYDFDFVTAENCQKSRIFFIAWSPDTSRVRSKMIYASSKDRFKRELDGIQVELQATDPTEMGLDVIKSRAN

SEQ ID NO: 774 - protein, 174 aa, Nicotiana tabacum
RIRSHYRQEKTNFIGALDFLLSSIRSLSFKIMANAASGMAVHDDCKLKFLELKAKRTHRFIIYKIEEKQKQVVVEKLGEPTESYEDFTAGLPADECRYAVYDFDFTTEENVQKSRIFFIAWSPDTARVRSKMIYASSKDRFKRELDGFQVELQATDPTEMGLDVFRSRVGGIEC

SEQ ID NO: 775 - protein, 258 aa, Nicotiana tabacum
SRRVAAAAASAAEAAAAAGESSFRSFMVAVQRCGSSVAIVQQYFANSISRLLLPVDGAHAASCEEMATAMSSAEGAAYKGLQQCIETVMAEVERILSTEQKATDYRSPDDGIAPDHRPTQACSKVVAYLSRVLESAFTALEGLNKQAFLAELGNRLHKGLLNHWQKFTFNASGGLRLKRDITEYGEFVRSFNAPSVDEKFEQLGIMANVFIVAPESLSTLFEGTPSIRKDAQRFIQLREDYKSAKLAARLSSLWPSSS

SEQ ID NO: 776 - protein, 139 aa, Nicotiana tabacum
MANAASGMAVHDDCKLKFLELKAKRTYRFIVFKIEEKQKQVIVEKLGEPAESYEDFAASLPADECRYTVFDFDFVTEEGCQKSKIFFIAWSPDTAKVRSKMIYASSKDRFKRELDGIQVELQATDPTEMGLDVFKSRTT

SEQ ID NO: 777 - protein, 196 aa, Nicotiana tabacum
WVVSTEYQGLKIRKILGQFPLFYISQVFSSLNPLSLHKKEKNRKISSVRSFRSSRFTMANSASGMAVHDDCKLKFLELKTKRTYRFIVFKIEEKQKQVIVEKLGEPAESYEDFCTHLPADECRYAVYDFDFLTKESVPKSRIFFIAWSPDTSKVRSKMIYASSKDRFKRELDGIQIELQATDPTEMGLDVFKSRAN

SEQ ID NO: 778 - protein, 139 aa, Nicotiana tabacum; identical to SEQ ID NO: 773

SEQ ID NO: 779 - protein, 181 aa, Solanum lycopersicum
RTPLLRIWSHFPPNTNFIGALNFLHFSHLFQICFLASIMANAASGMAVHDDCKLKFLELKAKRTYRFIIYKIEEKQKQVIVEKLGEPTESYEDFAAGLPADECRYAVYDFDFMTEENCQKSRIFFIAWSPDTARVRSKMIYASSKDRFKRELDGFQVELQATDPTEMGLDVFRSRAGGIEC

SEQ ID NO: 780 - protein, 139 aa, Solanum lycopersicum
MANAASGMAVHDDCKLRFLELKAKRTHRFIVFKIEEKQKQVVVEKVGEPAQGYEDFTACLPDNECRYAVYDFDFVTAENCQKSRIFFIAWSPDTSRVRSKMIYASTKERFKRELDGIQVELQATDPTEMGLDVIKSRAN

SEQ ID NO: 781 - protein, 204 aa, Solanum lycopersicum
MSIFEYNGSALVAMVGKNCFAIASDRRFGVQLQTIAIDFQRIYKIHDKLFIGLSGLATDTQTLHQRLMFRHKLYELREDRDMKPETFASLVSAMLYEKRFGPYLCQPVIAGLGEDDKPFICTMDSIGAKELAKDFVVSGTASESLYGACEAMYKPDMGPEELFETISQALLSSVDRDCLSGWGGHVYVVTPTEVTERILKGRMD

SEQ ID NO: 782 - protein, 432 aa, Solanum lycopersicum
  misc_feature (103)..(103): Xaa can be any naturally occurring amino acid
  misc_feature (110)..(110): Xaa can be any naturally occurring amino acid
  misc_feature (184)..(184): Xaa can be any naturally occurring amino acid
MEEGGLILYLRLLAVAYEKTQELARDLRGVRGGDLDVEGLTESLFLPHKAIYIEYEQASLRQLYKAKMEELRAEGQQSSESSGTIGRSKGASMASSHQQISVXVVTEFVXWNEEAVSRCTLFSSQPAAIAANVRAVFTCLLDQVSIYITEGLERARDSLTEAAALRERFVLPSVSRRVAAAAAXAAEAAAAAGESSFRSFMVSVQRCGSSVAIVQQYFANSISRLLLPVDGAHAASCEEMATAMSSAEGAAYKGLQQCIETVMAEVERVLSTEQKVADYRSPDDSIVPDHRPTQACSKVVAYLSRVLESAFTALEGLNKQAFLTELGNRLHKGLLNHWQKFTFNASGGLRLKRDITEYGEFVRSFNAPSVDEKFEQLGIMANVFIVAPESLSTLFEGTPSIRKDAQRFIQLREDYKSAKIAARLSSLWPSSS

SEQ ID NO: 783 - protein, 186 aa, Solanum lycopersicum
  misc_feature (171)..(171): Xaa can be any naturally occurring amino acid
PHRSKFTETPLFSSTKSSFLTSYFLTTLISLNFRSSSNLILSLCTINMANAASGMAVHDDCKLTFLELKTKRTHRFIVFKIEEKQKQVVVEKVGEPTQSYEDFAESLPADECRYAVYDFDFVTEENCQKSRIFFIAWSPDTARVRSKMIYASSKDRFKRELDGIQIELQAXDPTEMELDVIKSRAN

SEQ ID NO: 784 - protein, 217 aa, Solanum lycopersicum
MAGYRAEDDYDYLFKVVLIGDSGVGKSNLLSRFTRNEFSLESKSTIGVEFATKSLTVDSKVIKAQIWDTAGQERYRAITSAYYRGAVGALLVYDVTRHSTFENVERWLKELRDHTDPNIVVMLVGNKSDLRHLVAVSTEDGKSFAEKESLYYMETSALESTNVENAFAEVLTQIYHVVSRKAMENGENGNGNVPSKGEKIDIGKEVSDVKKAGCCSS

SEQ ID NO: 785 - protein, 204 aa, Triticum aestivum
MSIFEYNGSAVVAMVGKNCFAIASDRRLGVQLQTVATDFQRVFKIHGKLYIGLSGLATDAQTLYQRLVFKHKLYQLREERDMKPETFASLVSALLYEKRFGPYFCQPIIAGLGEKDQPFICTMDCIGAKELAKDFVVSGTASESLYGACESMYKPDMEPEELFETISQALLSSVDRDCLSGWGGYVLIVTPTEVQERVLKGRMD

SEQ ID NO: 786 - protein, 232 aa, Triticum aestivum
PTSSGGDPLPSSSFPQSNSAAPVPATPAMSIFEYNGSAVVAMVGKNCFAIASDRRLGVQLQTVATDFQRVFKIHGKLYIGLSGLASDAQTLYQRLVFKHKLYQLREERDMKPETFASLVSSMLYEKRFGPYFCQPIIAGLGQDDEPFICTMDCIGAKELAKDFVVSGTASESLYGACESMYKPNMEPEELFETISQALLSSVDRDCLSGWGGYVLIVTPTEVQERILKGRMD

SEQ ID NO: 787 - protein, 204 aa, Triticum aestivum
MSIFEYNGSAVVAMVGKNCFAIASDRRLGVQLQTVATDFQRVFKIHGKLYIGLSGLATDVQTLYQRLAFKHKLYQLREERDMKPETFASLVSALLYEKRFGPYFCQPIIAGLGEKDQPFICTMDCIGAKELAKDFVVSGTASESLYGACESMYKPDMEPEELFETISQALLSSVDRDCLSGWGGYVLIVTPTEVQERVLKGRMD

SEQ ID NO: 788 - protein, 243 aa, Triticum aestivum
LPHLPLPPSLSSFATPHNQIADATGAMAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHATFENAERWLKELRDHTDPNIVVMLVGNKSDLRHLVAVPTDEGKSFAERESLYFMETSALESTNVEDAFAEVLKQIYRIVSKRAVEAGEESAAGPGKGEKINMKDDVSAVKKGGCCSS

SEQ ID NO: 789 - protein, 219 aa, Triticum aestivum
  misc_feature (112)..(114): Xaa can be any naturally occurring amino acid
HEAMMQLKELFNVNHFIVSQTNPHISPLLRMKEIVRAYGGRFAGKLARLAEMEVKYRCNQVLEIGLPLGGLAKLFAQDWEGDVTMVMPATVAQYLKIIQNPTYPELQMAANXXXRCTWEKISAIRANCAIELALDESIAALNHKRRLRRSIERAAASSQGYTDSVRLKTPRRVPSWSCISRENSSGSLSEDHFAAAISSNHQGTIRVDGAPHTSHHVRQ

SEQ ID NO: 790 - protein, 233 aa, Triticum aestivum
LPPISSSGDPLPSSFPQSNSAAPVPATPAMSIFEYNGSAVVAMVGKNCFAIASDRRLGVQLQTVATDFQRVFKIHGKLYIGLSGLASDAQTLYQRLVFKHKLYQLREERDMKPETFASLVSSMLYEKRFGPYFCQPIIAGLGQDDEPFICTMDCIGAKELAKDFVVSGTASESLYGACESMYKPNMEPEELFETISQALLSSVDRDCLSGWGGYVLIVTPTEVQERVLKGRMD

SEQ ID NO: 791 - protein, 229 aa, Triticum aestivum
NRSRRAPPPPLAPPPPPPSVASLPAMSIFEYNGSAVVAMVGKNCFAIASDRRLGVQLQTVATDFQRVFKIHGKLYIGLSGLATDAQTLYQRLVFKHKLYQLREERDMKPETFASLVSALLYEKRFGPYFCQPIIAGLGEKDQPFICTMDCIGAKELAKDFVVSGTASESLYGACESMYKPDMEPEELFETISQALLSSVDRDCLSGWGGYVLIVTPTEVQERVLKGRMD

SEQ ID NO: 792 - DNA, 1079 bp, Gossypium hirsutum
ggattccggtgacggtgtttctcacaccgtgccaatctatgaaggatatgcccttccacatgccatcctccgtcttgaccttgcaggtcgtgatctaaccgatgccttgatgaagattcttaccgagagaggttacatgttcaccaccactgctgaacgggaaattgtccgtgacatgaaggagaagcttgcttatgttgccctggactatgagcaggaactggagactgccaagagcagctcatctgttgagaagaactatgagttgcctgacggacaagtcattactattggagctgagagattccgttgcccggaagtcctcttccagccatctttcatcgggatggaagctgctggaatccatgaaactacctacaactctatcatgaagtgcgatgtggatatcaggaaggatctctacggtaacattgtgctcagtgggggttcaaccatgttccctggtattgcagaccgcatgagcaaggagatcactgctcttgctccaagcagcatgaagattaaggtcgttgcgccaccagagagaaagtacagtgtctggattggaggatctatcttggcatcactcagcaccttccagcagatgtggatttccaagggtgagtatgatgaatccggtccatccattgtccacaggaagtgcttctaagttttgtaattgcttttgatggtgatctacattttgcatttagttggctttttttgtgtgcgatgttaagtgaagtccaaagtctggtttatgtggggagagttagggatcattgtaggatggtgtacttgatattgacgtattattattttagcctttcaccgtatcaccaccattaagatgatgggtcctatggagatggcggtgggcggacaattggtgcttaattccttccttataatccatctttgaaccatgttgcttaaaaggatgtttggagctggagactggattgtggtgcttttttattttattttattatttaatattcaagggttttgagaacattaatgttcatagctattattgtacgagattttttttgaaaaattagagtcagtttgcggtc

SEQ ID NO: 793 - DNA, 21 bp, Artificial sequence
  Single strand DNA oligonucleotide
tcgtgatctaaccgatgcctt

SEQ ID NO: 794 - DNA, 21 bp, Artificial sequence
  Single strand DNA oligonucleotide
acaatttcccgttcagcagtg

SEQ ID NO: 795 - DNA, 657 bp, Gossypium hirsutum
cggccgcgtcgacttttttaataaaactgaaacaacccttcttcacacaaaaatatgctccgtacaattcgtttattctctcatagcatctcttctaaattaaaattgctaaagcttggatacacaaagcacaatcactcactcacttaagccttagacatgtgtcggatcaagtcgataacacgggaactgtaaccccattcgttgtcataccaagtcacaagcttaacaaagttgtcattcaaagcaattccagccttggcatcaaaaatgcttgacctgttgtctccgatgaagtcagttgagactaaatcttcgtccacataaccaagaattcccttcaagttgccttcagattccgccttgatagcagccttaatttcatcatatgtagccttcttctcaagtctcacagtgaggtcaaccacagagacatcaacagtgggaacacggaaagccattccagtcagcttgccattcagtgctggcaaaactttgccgacggccttggcagctccagtgctgctaggaatgatattgaaggaagcagctctaccacctctccagtccttcatggaatgaccatcaacagtcttttgtgtagcagtaatagaatgaacagtggtcataagaccctcaacgatgccaaatttatca

SEQ ID NO: 796 - DNA, 21 bp, Artificial sequence
  Single strand DNA oligonucleotide
tcagattccgccttgatagca

SEQ ID NO: 797 - DNA, 23 bp, Artificial sequence
  Single strand DNA oligonucleotide
ctctgtggttgacctcactgtga

SEQ ID NO: 798 - DNA, 649 bp, Gossypium hirsutum
  misc_feature (423)..(423): n is a, c, g, or t
  misc_feature (492)..(492): n is a, c, g, or t
  misc_feature (504)..(504): n is a, c, g, or t
  misc_feature (627)..(627): n is a, c, g, or t
  misc_feature (630)..(630): n is a, c, g, or t
gagaaaaggaagacaacgatggtgtctctgaagttacagaagcggctcgccgctagcgtcctgaagtgtggccgtggcaaggtttggcttgatcctaatgaaatcaatgaaatctccatggccaactccaggcagaatgttaggaaacttgttaaggatggttttatcatccggaagcctaccaagattcactcccgatctcgtgcacgcagaatgaaagaggccaagagaaagggtcgtcattctggctatggtaagaggaagggtaccagggaggcaagattgcctacaaagatcctttggatgaggagaatgcgagtactaaggcgtttgcttcgtaagtacagggaatccaagaagattgacaagcacatgtaccatgacatgtacatgaaggtgaagggtaatgtatttaaaaacaancgtgtcttgatggaaagcatccacaagtccaaggctgagaaggcaaaaaaaaaaacactctcaaatcantttgaggccaancgaactaaaaacaaggcgagcagggagagaaagatggccagaaaggaaaaacgccttgcacagggacctggtgtgaaagcagcacctgcagctgcaccgcaacaggccgaaggagttaaaaantcnaagaaatgaatgaggtact

SEQ ID NO: 799 - DNA, 23 bp, Artificial sequence
  Single strand DNA oligonucleotide
cctaccaagattcactcccgatc

SEQ ID NO: 800 - DNA, 24 bp, Artificial sequence
  Single strand DNA oligonucleotide
cctcttaccatagccagaatgacg

SEQ ID NO: 801 - DNA, 28 bp, Artificial sequence
  Single strand DNA oligonucleotide
cacccgggaccaccatcaaaccacatcc

SEQ ID NO: 802 - DNA, 28 bp, Artificial sequence
  Single strand DNA oligonucleotide
gagagctctccaaaattgacacaccagg

SEQ ID NO: 803 - DNA, 28 bp, Artificial sequence
  Single strand DNA oligonucleotide
aacccgggttccctttccaagcttcagc

SEQ ID NO: 804 - DNA, 28 bp, Artificial sequence
  Single strand DNA oligonucleotide
cacccgggtacctaaagttgcagcttgc

SEQ ID NO: 805 - DNA, 28 bp, Artificial sequence
  Single strand DNA oligonucleotide
ttcccgggttgcctttttgtcatttccc

SEQ ID NO: 806 - DNA, 30 bp, Artificial sequence
  Single strand DNA oligonucleotide
cagagctcttgtttatgaatccactttggg

SEQ ID NO: 807 - DNA, 28 bp, Artificial sequence
  Single strand DNA oligonucleotide
gacccgggaaacgatggaggatcttgcc

SEQ ID NO: 808 - DNA, 33 bp, Artificial sequence
  Single strand DNA oligonucleotide
cagagctcttggaattgaaatgtcattacagag

SEQ ID NO: 809 - DNA, 31 bp, Artificial sequence
  Single strand DNA oligonucleotide
ttcccgggcactcttcattcctcacctactc

SEQ ID NO: 810 - DNA, 28 bp, Artificial sequence
  Single strand DNA oligonucleotide
ttgagctctggatttctgaaaacaaccg

SEQ ID NO: 811 - DNA, 28 bp, Artificial sequence
  Single strand DNA oligonucleotide
aacccgggcaccacctccactcaccttc

SEQ ID NO: 812 - DNA, 30 bp, Artificial sequence
  Single strand DNA oligonucleotide
ttgagctctgctcttatatcatgtgaaggc

SEQ ID NO: 813 - DNA, 29 bp, Artificial sequence
  Single strand DNA oligonucleotide
cacccgggaactcttcaagaccattcgac

SEQ ID NO: 814 - DNA, 31 bp, Artificial sequence
  Single strand DNA oligonucleotide
acgagctcagctagataaatcacaaccatcc

SEQ ID NO: 815 - DNA, 27 bp, Artificial sequence
  Single strand DNA oligonucleotide
tgcccgggttcagcgttcgaatccatg

SEQ ID NO: 816 - DNA, 28 bp, Artificial sequence
  Single strand DNA oligonucleotide
gtgagctctgcctgacacattgacatgc

SEQ ID NO: 817 - DNA, 30 bp, Artificial sequence
  Single strand DNA oligonucleotide
ctcccgggtttgaagctcaggaactaatgg

SEQ ID NO: 818 - DNA, 27 bp, Artificial sequence
  Single strand DNA oligonucleotide
ttgagctcagggaccaatttgttgcca

SEQ ID NO: 819 - DNA, 27 bp, Artificial sequence
  Single strand DNA oligonucleotide
acgatatcaagaatccgacccggtaac

SEQ ID NO: 820 - DNA, 29 bp, Artificial sequence
  Single strand DNA oligonucleotide
ctgagctcggaagtaaatttggacactcg

SEQ ID NO: 821 - DNA, 29 bp, Artificial sequence
  Single strand DNA oligonucleotide
aacccgggccctaagatgacaaaccaaga

SEQ ID NO: 822 - DNA, 31 bp, Artificial sequence
  Single strand DNA oligonucleotide
tggagctcaataatcatgtggcagtagtttg

SEQ ID NO: 823 - DNA, 28 bp, Artificial sequence
  Single strand DNA oligonucleotide
gacccgggaaacatggaaggagacgatg

SEQ ID NO: 824 - DNA, 29 bp, Artificial sequence
  Single strand DNA oligonucleotide
cggagctcaaaagcattcagaacaaccag

SEQ ID NO: 825 - DNA, 30 bp, Artificial sequence
  Single strand DNA oligonucleotide
agcccgggaaacatgtttgcaggagatcag

SEQ ID NO: 826 - DNA, 30 bp, Artificial sequence
  Single strand DNA oligonucleotide
aggagctcaattacaaccaaaggttaaccc

SEQ ID NO: 827 - DNA, 32 bp, Artificial sequence
  Single strand DNA oligonucleotide
accccggggagctctggatacagttaagaatc

SEQ ID NO: 828 - DNA, 33 bp, Artificial sequence
  Single strand DNA oligonucleotide
ctcccgggtagacttgtagtaaagcatgtatcc

SEQ ID NO: 829 - DNA, 32 bp, Artificial sequence
  Single strand DNA oligonucleotide
atcccgggagttaactggtctcttctgatgtc

SEQ ID NO: 830 - DNA, 32 bp, Artificial sequence
  Single strand DNA oligonucleotide
tcgagctcaacaactataccagtcattgcttc

SEQ ID NO: 831 - DNA, 27 bp, Artificial sequence
  Single strand DNA oligonucleotide
aggatatctttcgatcaccgtgatggc

SEQ ID NO: 832 - DNA, 27 bp, Artificial sequence
  Single strand DNA oligonucleotide
gcgagctcgtagtgacgtcaccggttc

SEQ ID NO: 833 - DNA, 28 bp, Artificial sequence
  Single strand DNA oligonucleotide
gacccgggagacacacaaagcgagaagg

SEQ ID NO: 834 - DNA, 30 bp, Artificial sequence
  Single strand DNA oligonucleotide
aagagctctatcacttacatcctaggcagc

SEQ ID NO: 835 - DNA, 28 bp, Artificial sequence
  Single strand DNA oligonucleotide
ttcccgggtctggcttgaaaatggtgtg

SEQ ID NO: 836 - DNA, 32 bp, Artificial sequence
  Single strand DNA oligonucleotide
aagagctcgcattgaacttcatcatctgtaag

SEQ ID NO: 837 - DNA, 29 bp, Artificial sequence
  Single strand DNA oligonucleotide
cgcccgggtttttccaactaaggttaggc

SEQ ID NO: 838 - DNA, 28 bp, Artificial sequence
  Single strand DNA oligonucleotide
cacccgggccaataaacaatagcactgc

SEQ ID NO: 839 - DNA, 22 bp, Artificial sequence
  Single strand DNA oligonucleotide
ggtggctcctacaaatgccatc

SEQ ID NO: 840 - DNA, 20 bp, Artificial sequence
  Single strand DNA oligonucleotide
aagttgggtaacgccagggt

SEQ ID NO: 841 - DNA, 877 bp, Cauliflower mosaic virus
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 842 - DNA, 1143 bp, Gossypium hirsutum
  misc_feature (24)..(24): n is a, c, g, or t
tgtgtataaatatgtagacacagnagatccaatatattttcactttcacagcaaccttcttctccactcctccatctatatatatagttagaggcagaagggaggaagtgacattggcaatatggctttgctgcattcttacttcttaagcgctggtgagtatgtttcagggtccacggtcttggcagtggcaatgtccattgcttcctattttctgatccctatggtgtttggtggtcgccataaaaactggaagaatgcaccaccaggccctgttggttggcctatccttggcagccttccacacctctccaatcgtctccatgaagatttctttgacatggccaaggtctacggtccccttttcagtctaaacttgggaataaagccggccatagtggtgtcatcaccggaaatggcagcccaagttttgaaggaaaaggaagggatgttctccagtcggaccataaccgagaccattcgagtcatctcttatgatgcccattccatcattttctcgccctatggtcccaggtggaaggttcttcgaaggatcttgatcaccgaactactttctcctaaggcctttgaacaatttgagccacttcgtacctcacaggttcatggtttgctcaagtatttgtacttggtctcaaagtccaacactcaagtgaacatagcagaatatgcttttacagcactggccaacctagtgagtaatttcgtctgctccaaggaccttttcgacaactcaatgcctgaaggaagaaaaatgaaagagaggttctgggagttgataaaggtgattgggaccccgaatttttctgatctcattccatttgttaaaccatttgatccacaaggccttgaagagaaaaatcaacaagatctycggacagttggatgctttctatgagaagtatatcgaggagaagtttgctgacaagggaaaagctcaacttgatgggacgataccctaccaacggaaaaatggatatgttagatgttctgttgagttatgagaagaattgataaacaaaatgggtttggacccgtttaccacaatcctatcgtccaaaggaatgcttttctgaaaatggttaattggcagcgaactgaaaaacacccctcaacgcacctggg

SEQ ID NO: 843 - DNA, 1480 bp, Gossypium hirsutum
cccgggtaccattactctactacagctgctatcattactacatacatgtccacccaaagtcgagcagttggcggcaccgagcacaactggtgccgagcggtggtcgggggaaccgggatagccgtcttggctatcatttcttccaaaaaccccgacgtttcacatcttaaaaatgccctccacaagctccaaatctcccatcccattcttaggtctcgcctccattacagtcctactgccaacagttactccttcgttacctccccctcccctttcattcaaatcaagtactttaaccattctacaacttgtcaaatccttgaaaacaaccaaaacatctcaccccttcatttgattctcgaacacgagcttaaccaaaacgcttgggttagttcttcatgtaccaccaaacacgacgtgtttttcgccagtgtttatgccttgcctggtgcaacaaggtgggtgttggtgctccgcctacatgcggctgcttgtgaccggaccacggcggtgtcgttgctgagagagttgttgacgttaatggctattgaggaggaggaaacagggtttcagcaaggtcaaaaagaaattacgatgaacaaaggagagatcagtttggccatggaagatattcttccaaaaggcattgttaagaaaacactttgggcacgaggagtggacatgctaagctactctgttaattctttaaggttcacgaacttgaggttcaaagatgccaaatctcctagatctactcaagtagtgaggttgcttatcaaccctgatgacactcagaagatcttgactggttgcaaggcaagagggattaagttatgtggagcattaggagctgccgggctgatttctgcacacagttctaaaagccgttcagatcatcaaaagaagaaatatggcgttgtaacactcacagattgccgctcaattcttgaacctccgctctccaatcaccatttcggtttttaccactcagctattctgaacacgcacgccatcaaaggaggagagaagctttgggagctagcagagaaagtgtacaccgtatttacacactacaagagctgcaacaagcacttgtcagacatggcagacctgaatttcttaatgtgcagggccatggagaaccctggcttgactccatctgcctcattgaggacatgtttgatatcggtcttcgaggatacggtgatagatgagtctagtaaccagcaaaatcaagtcggcgtagaggactatatgggatgcgcttccgctcatggcatcgcgccgtccatcgcgatattcgacaccatacgagatgggcgactggattgcatttgcgtttatccttcgccgttgcattcaagggaacaaatgcaggagctggttgataatatgaagtgcatacttgtggatgcagggaagaatgttgctgatgaaactgagagttaaggagccagtctggtctttgtctgttgagctc

SEQ ID NO: 844 - DNA, 720 bp, Gossypium hirsutum
acccccgggcaagtgatcaaagagaatgggaagaggaaaaatagagataaagaggatcgaaaacacaacaaatcgtcaggttaccttttgcaaacgcaggaatggcctgctgaagaaagcttacgaactgtcagtcctctgtgatgctgaagttgctctcattgtcttctccagtcgaggccgtctgtatgagtactccaacaacaacataagatcaacaatagacaggtacaagaaggcttgctcagatacttctaacacaaacactgttactgaaatcaatgctcagtattatcaacaagaatcagccaagttgagacagcagattcaaatgttacagaattctaacaggcacctaatgggagattccttgagttccttaactgtgaaagagttaaagcaggtagaaaacaggcttgaaagaggaattactaggatcaggtccaagaagcacgaaatgctactagctgaaatagagtttttgcagaaaagggaaatcgaattggaaaatgaaagtgtttgtctccgaaccaagattgcagaaattgagaggcttcagcaggcaaacatggtgactggacctgagcttaatgctattcaagctttagcttctcgcaatttctttagccccaatgtcattgagcatccatctgcttactcccatctctctgacaagaagattctccatcttgggtagaggagttggagaaagagctcatg

SEQ ID NO: 845 - DNA, 942 bp, Gossypium hirsutum
cccgggcatacagagatggagaggcaaagaagcaagcaggtttgtttgttgatgtgggttttggttgctgcctttttctcccacaatagggtcattgcagtgacctccactggccttggtgagcagaaaaactactatccagctcctgaccctcatgctggaactcccccttcaggttcacatggcacaccaccatcttcaggaggtggatcacctccctctcatggaaccccgtcacatggaggtggttaccacccttcaccaacaccatcaacgccttcgggtggaaattgtggaactcccccacatgacccttcaactccatcaacaccatcacacactcctcctcatggtactccaccatcatctggaggtggtagtcccccatcgtatggaggaggcagtcccccatcgtatggaggaggcagtcccccatcgtatggaggaggcagtcccccatcatacggaggtggcagtcccccatcatatggaggtggcagtccaccaactactcccattgatccaggaactccaagcattccctcacctccattctttcctgctccaactccaccaattggtggtacatgcgatttctggaggagtcaccccacactgatatggggtctgcttggttggtggggcactgtaggcaacgcatttggcgtgaccaacgctcctggacttggaacaagcatgagcttgccccaagcactttcaaacacacgtactgatggacttggggcgctttaccgggaaggaacagcctcatttctcaactccatggtgaataataggttcccattctcgactaagcaagtcagggagacttttgttgcagcacttggttcaaacagcgctgcagcagctcaggctcgtctcttcaagcttgccaatgaaggccacctcaagccaaggacctaagcaaacacctttgagctc

SEQ ID NO: 846 - DNA, 26 bp, Artificial sequence
  Single strand DNA oligonucleotide
gtggaccctgaaacatactcaccagc

SEQ ID NO: 847 - DNA, 27 bp, Artificial sequence
  Single strand DNA oligonucleotide
aagccatattgccaatgtcacttcctc

SEQ ID NO: 848 - DNA, 1773 bp, Gossypium hirsutum
  misc_feature (22)..(22): n is a, c, g, or t
  misc_feature (79)..(79): n is a, c, g, or t
  misc_feature (195)..(195): n is a, c, g, or t
  misc_feature (312)..(312): n is a, c, g, or t
cctatcttgaaaaatatttgcnttatacttaacgttaattaatatgttatttttagtaataacatattcttaattttanaccagcaagttatcagtttctttcatgaacatggtttgaaaattatatattcaaaattaaaaaattatttgaaattttacctgtttattttaccttctaatatttaaggtttaatntaccatttacgattcgagtttgtataatttttttaccattggatttctatttttttttgtttattatctttttaatatttaatgtagtttttaaaattgatttgatgtaaatttagnattaattatgttatgtataaaatataaagcatgccacttttcaccatcatctaactcgttcgttcattattcaggacatgcgtgcttactagtcatcttagtgcacaacgtatagtctgaataaccaatgtcttgctcgccaacatcctcctgagagcaactaaggatgcgtgtcatccctagggggtaacgtgctgctgcgcatggtgtctagctactcctgatacatcatattaatagaccatgtcttataaatatgaagagaaatctccatgagaagggataacaaaattaacactcaacaaattaaacaattttacactaaaactttactcttaaaattcttgtctaagaaatctcttttttctttttctttttctctctttttatacttctaaaatggtaaaacttcaacttgcctttgaaaaaaaagtaaattaaagttagaaaataaataaaaaaagtgtaataaatggtaatcctagtaacatttttctataaaaagtaatttccttccgaattaaagttaaaaaaaataaataagtgtaataaatggtaatcctaataatatttttctataaaaagtcatttccttcctaattaaagttaaaaaaaataagcgtaataaatggtaatcctaataacatttttctataaaaagtcatttcctccccaattgaagttaaaaaatagataagtgtaataaatgataatcttaataacaattttttatccttcccttaaagataaaaaaataaaaaataaaaaggtgtaataaatgataatcctaataatattttttttataaaaagttatttccttcccatactaatatcacacgactttttaaatttcacaagtaaaattaagatgatamcaagtatagcataaaatattaagaaaaatatgacacataacaaactagtgtactaaatactaacccataatacaaataaaatgtttgaagtgtgtgcaagttgaaagtgaatataaaattgacagcagagcatgtgtgtgttgaaagtaatgcaagtaatgaatccttgtcatgcattaatttggccataaatacatccttgtcatattacccttctgatatatgttcttacaaagctagtaatgggaaagtttcagattcttcatgtcatgacaaaaaggctttagcagtttgttgagaaaagcagttacgtacgccagaaacaatgtaaattattttgattccattcccatttatccaaattgtaacgctcgagtatccaagttcatcattatcatcgctgaatcatattttctatgcatcaaaatgtaaatttaaatttttggatattcagttctcttcattgtgtataaatatgtagacacagagatccaatatattttcactttcacagcaaccttcttctccactcctccatctatatatatagttagaggcagaagggaggaagtgacattggcaat

SEQ ID NO: 849 - DNA, 27 bp, Artificial sequence
  Single strand DNA oligonucleotide
gcatgagggtcaggagctggatagtag

SEQ ID NO: 850 - DNA, 27 bp, Artificial sequence
  Single strand DNA oligonucleotide
cttctttgcctctccatctctgtatgc

SEQ ID NO: 851 - DNA, 1726 bp, Gossypium hirsutum
tggtctgtccggatcactgtgcttcaacaactagccctttttttggtcatataaaagtttaggggattggagaggttgccacccaatgtcacggcattcccatcagtctagctgaaagtgtgatatttatagatcatttatcaaatgaagttatcagtgaaatgccaactttagtgcttatcaaagtgataataagcactgagccaatgcatgttgacattagtctttgaaatctaaaccagaaattatctcacataatgtttacattgtaaaatcacaggctaactatcactcttaagaatccaacaaggttttcattagggaaatgatagccaagatgaaccacaccatattaagagcaggttccatattgggaagttttaggactaatgtatcatctatgaggttccaaatgagttttaggattagtgtatgaaacgaaattttatggctacaatacatttccaagtactgtttccttttaaacatcccaataaattggaaggacatatatctttgtctacggttcagaccacagagctatgggttattcttgtattaaaattgttcgaattcatcttataattatattcaatacatataattagtgagtcattttagatcatttctatattcatatttgttgagggagattgatttctttggaagaaattttcaaagtgtcatccttaaggttgccgatttggtccctcaacaatggaaggtattatcctcttagggagggttttgtcgcccctccccgtcctcaaggatgccgacccgatccctcaacaatggaaggtattgtccctcaacagatgacctatccgtaggctaggggttcgaatcctaccaagggtgggatgctcacgtcacctcttggtcagcagtcgtaaatccacgtacggttaaggtgtccccttccgtgaattggacacggctctttgtggaggagggacaaaatcctcccctgaggactataccttccgttgttgagagactgaatcggcatccccaagaatgacacttcaaaaatttctcctaaaagaactgatctccctcaataatattgtgtttgtattttgttttcttgtgttgtgttatatttttaatctttttttcaaatcatatttgtgcgttttatccaaaattaataaattatcaaatcttgataagagggatgtcttgggagacagatactaatgtttaagcaaacattaatctcatgcctataccaacctattgattttatatttatatacgtctcctgtggtaagtgaagatggtcccaattcatttatctctcttcattggattacatctccacttggacttacccattaatcagtaatttcttttctccctaaaagttgataattatcgtccaatatcctagtcttgtgaacaaaattatctgatgatgataatcaaatataatatgcctgattgtaatccaaagtgacccgcccatgttccatgagttgaagtcctcgttagaaagaccatttcaagttcagcattgtttcagcaattcaaaagttaataattaatacaaacatataaatgcacctgctgtcatcaactaacctcatgcaggttcacctgtttcatttacttcacctagttagtgctgtatattgaccatccccctcattcttctcaactcacacatcttccaatctttcattctttgctgttgaagtagtaatatctatagcatacagag

SEQ ID NO: 852 - DNA, 27 bp, Artificial sequence
  Single strand DNA oligonucleotide
acctgaggtattttggtaagagttccg

SEQ ID NO: 853 - DNA, 25 bp, Artificial sequence
  Single strand DNA oligonucleotide
ccaattcagctttcggaaaatcacg

SEQ ID NO: 854 - DNA, 867 bp, Gossypium hirsutum
acactaaatatatataactttaaaattttatacatattttcatataaatatatgtaattgaaatatatttacatatgtatattatatattattaataaaattggaaataaactatatgtatgaaattttttaaaaatattgaggccattaaagttcatcaaaacacatcatttggcatcaaattaaacaaaaccttaaaatatatttagaaatatttaaaaaaatattgataaactttgatagattaataccaagctaaaatcaatagttcccctaatgtagtagtactgaaattgtagaatattatcttgatatggggttagactaatcttagtgggggtattattacacagtgtacgtagtgcaggacaacgtgtatggcaccaaaaccctaactccatagaaatggaaggcaaagatagagagtgtgaacgttgagtctgagtctaaacaccgcccattaaatggagacagtagaaaagattcgagaagggcacgttagtgagttcagggactttaaataaggattacaaaatatggaaacctcattgctaaaaatggtggaaatttgcacctgcaaagctcttttcattttgctaattctacaccctcttctctaaccctttcggcaaattacaattccaaggtctttttccaactctgaaaacttgagtgagtctcccaccccatctctctaagctccctccctataatatcacctataagcttaggcctaccctcctcggaggaaagttattaaatatatactctcaaaacactttgctttctttgggattcgtgattttccgaaagctgaattggccggaactcttaccaaaatacctcaggtgcaagtgatcaaagaga

SEQ ID NO: 855 - DNA, 26 bp, Artificial sequence
  Single strand DNA oligonucleotide
ggcatttttaagatgtgaaacgtcgg

SEQ ID NO: 856 - DNA, 28 bp, Artificial sequence
  Single strand DNA oligonucleotide
gctcgactttgggtggacatgtatgtag

SEQ ID NO: 857 - DNA, 699 bp, Gossypium hirsutum
  misc_feature (512)..(512): n is a, c, g, or t
  misc_feature (584)..(584): n is a, c, g, or t
taagccataaaaaaatgtagaaaaccctattagaattttttctttgggtctcccgtctaaacttatcctgataatttttttttgtagtatttttaagaaaattgacatcaacattttaattgaataattaacaatattgattatttagattaactaatgatatttaaaataaaggaacccaataatattaaaaaattaaaatatattgactaaatgtcaagttttaacatagtataagaatcaaaattaaattttgaccattattttataatgtaagaataaaaaaaaatacaagataaactcagaaaaatagaaagctacgtgcccattataataagaatattaacgatttacctatttatactaataaataatataaagagtaaattaaattagaaattaaggacctccattttttatagtttatgtatctctcctgatagcaaatcattagtggtaaacattttgactcttttaaaaattatgtatttagaattttataaatttatgtnaagaaaaatttaactctgcctctaccggcccaatgagaagcagcattcatttaattcccctatatataaatntccaacttgctcaccgaaactaagcaaaggcagagggagcagtaaaaatatcccctcaccaccgctactattattataccattactctactacagctgctatcattactacatac

SEQ ID NO: 858 - DNA, 34 bp, Artificial sequence
  Single strand DNA oligonucleotide
atacaagcttgttgagggagattgatttctttgg

SEQ ID NO: 859 - DNA, 35 bp, Artificial sequence
  Single strand DNA oligonucleotide
caaagtcgacaagattggaagatgtgtgagttgag

SEQ ID NO: 860 - DNA, 36 bp, Artificial sequence
  Single strand DNA oligonucleotide
tgttaagcttgtaaaatcacaggctaactatcactc

SEQ ID NO: 861 - DNA, 31 bp, Artificial sequence
  Single strand DNA oligonucleotide
gtcgaagctttggtctgtccggatcactgtg

SEQ ID NO: 862 - DNA, 33 bp, Artificial sequence
  Single strand DNA oligonucleotide
acttaagcttggtaaaacttcaacttgcctttg

SEQ ID NO: 863 - DNA, 31 bp, Artificial sequence
  Single strand DNA oligonucleotide
caaagtcgacttgccaatgtcacttcctccc

SEQ ID NO: 864 - DNA, 31 bp, Artificial sequence
  Single strand DNA oligonucleotide
caacaagcttagcatgccacttttcaccatc

SEQ ID NO: 865 - DNA, 32 bp, Artificial sequence
  Single strand DNA oligonucleotide
atatgtcgacattgaggccattaaagttcatc

SEQ ID NO: 866 - DNA, 31 bp, Artificial sequence
  Single strand DNA oligonucleotide
cattctagatctctttgatcacttgcacctg

SEQ ID NO: 867 - DNA, 33 bp, Artificial sequence
  Single strand DNA oligonucleotide
ttcgaagcttgtctcccgtctaaacttatcctg

SEQ ID NO: 868 - DNA, 36 bp, Artificial sequence
  Single strand DNA oligonucleotide
aggagtcgaccatgtatgtagtaatgatagcagctg

SEQ ID NO: 869 - DNA, 20 bp, Artificial sequence
  Single strand DNA oligonucleotide
gctatgaccatgattacgcc

SEQ ID NO: 870 - DNA, 20 bp, Artificial sequence
  Single strand DNA oligonucleotide
ctgcatcggcgaactgatcg

SEQ ID NO: 871 - DNA, 723 bp, Artificial sequence
  GFP (green fluorescent protein) coding sequence
atgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaagcggcacgacttcttcaagagcgccatgcctgagggatacgtgcaggagaggaccatcttcttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcatggccgacaagcaaaagaacggcatcaaagccaacttcaagacccgccacaacatcgaagacggcggcgtgcaactcgctgatcattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaagtcaacctga

SEQ ID NO: 872 - DNA, 1998 bp, Artificial sequence
  GUSint (beta-glucuronidase) reporter gene
atgttacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggccaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 873 - DNA, 1046 bp, Gossypium hirsutum
aagctttttttgtttgttgtgggggtgttatttgaagtagcatagcatttaaatcgaattaaggaagcagctcctttaatttagttttgttggttgtcaatgccaataaaaaggagacagggtttgaataatgcaatgcaattcaagacccaatgatcctaacaaacgttcaaggagcacactcaaatcccaacaaccattccatcctgatggatgtggaaaagcaaatttaattaaggagcctctcaaacttagagctcttgccacagcacatgatgcatttttcaacagatcagaacaagtacaaggacaattaatcctagattatctcaacagcatgccacatgacccatgttccatttcgtatacatatgtctgccatttaatttaaaggtaaacatttgtgatgccaatgccaatgccttattcacctcacaaatcagtatccataaactagctgttttcaggccaggaggaccaacatgctcaagacttggcattccctaatgctgtgtgtccattggtcattgcacgtaaattggctctgtcttcatgcttccaaattattattattaatgaagaaaaataatttactctctgaaatcttgcaacgcaagccacgacccagaagctagagaagacaaataatacgatgataatttataactatatgtatagtagtgtaaatggcaatatatattaatataaaatcctaacccccaaaaagcaagcaactgagtttgactaccaggtgcagctgcatgcatgcattgcatgggatgcccttaccttttcaactgtccctctttgtttcactgtatagcattcaccagatctgatctaatgggaccacctctctctccccagctaaattggacaacaaccaatccaagctcaagacatataaatctcttctctttctctctatgttgtcctctctttaattttacctaccattacccttttctacttaatctctcattgcttacttatattgtaagtgtgaccaagtaaaccaagtacagaagctcaatgcccaaggatcc

SEQ ID NO: 874 - DNA, 1086 bp, Gossypium hirsutum
cccgggatggatggttattgtagcagaagggtaatcatgtttttggtgtttgcatttgcagcaataagcagagggtatggacaagaatcaaccactcttgttcctgcaatcatcacctttggtgactctgtggtagatgtgggcaataatgactatctccctaccatcttcaaggctaactatcctccttatggacgggactttgccaacaaaaagcctactgggaggttttgcaatggaaaattagccactgacatcactgctgaaactctggggtttacaacttatccaccagcttaccttagcccagaagcatcagggaagaaccttctgcttggagccaattttgcttcagctggctctggctatgatgacaaagctgccatggtgaatcatgccatcacattgacccagcaattagagtatttcaaggaataccaggcaaagctagcaaaggtagcaggcagcaccaaatcagcatccattaccaaggatgcactgtatgtattgagtgcaggaagcggtgacttcctccagaactactatgtcaaccctctacttaaccatgcctatactccagaccagtacggctcattccttattgataccttcacaaacttcgtcaagaacctctatgggttgggagctaggaaaattggggttacctcacttccaccgttaggttgcgttccattagcaagaacattgttcggttaccacgagaaaggatgcatctccaggttcaataccgatgctcaacaattcaataaaaagctcaacgccgcagcagccaatctccagaagcagcatcctggtcttaagattgtggttttcgacatattcaaggcactttacgacattgttaaatctccctctaactatggttttgttgaagcaacaaaagggtgttgtggaactggaacagtagagacaaccgcatttttgtgcaatccaaaggcaccaggaacttgttccaatgccagccaatatgtattttgggacagtgttcatccatctcaggctgctaatcaagtccttgcagatgcattgattgttcagggcattgccctcatttgattcgagctc

SEQ ID NO: 875 - DNA, 1975 bp, Gossypium hirsutum
tctagacaagtacagaagctcaattcccaagatggaggccagcagcagcacctcccatgacccagcattgttccatgctcccttgctataccaccctcggagaaggagcagcagacccttaaagggtttcgcagtgataattgggtccgtcgttttcctactctcactggtcacattaatcgttaaccaaagcccggagccattagcaagtaaccccagtagtgtaacggaggcagggtcgtattcaatggcggcgcagccaagagggatagctgaaggtgtttcagccaagtcaaacccatcactttttgacaaagttgggtttaattggacaaacgctatgttttactggcaaagaactgcctaccactttcagcctcaaaagaattggatgaatgatcctgacggtccgttatatcacaagggatggtaccatcttttctatcaatacaaccctgattcagccatatggggaaacatcacttggggccacgctgtatcaacggacctcattcactggttctatctcccactcgccatggtccctgatcaatggtacgatatcaacggttgttggacggggtcggccactctcctgccagatggccgaatcgtaatgctttacaccggcagcaccaatgactccgtgcaagtccaaaaccttgcatatcccgccaacctatctgatcccctcctccttcagtggttaaaatacccgggtaacccggttgttgttcccccaaccgggatcgaagacgaagagttccgagacccgacaacagcttggcttggacccgatggttcctggcggattgttgttggtacaaggtttaataccaccataggaacagcccttgtttttcaaacgacaaacttttcggactatgaattattggatggggtcttacatgctgttccgggtacgggtatgtgggaatgtgtagatttttaccccgttgcaataaacgggtcggtcggactggacacgacggcacttgggcctggaattaagcatgtcctgaaggctagtttggatgatacgaaagttgatcattatgcaatagggacctacgacatgataacggataaatggacacctgataacccggaagaagatgtaggcatcgggttgaaagtggattatgggagatactatgcctccaagacattttttgatcagagtaaacaaaggaggattctttatggttgggttaatgaaactgattctgaagctgatgacctcgaaaaaggatgggcttccattcagacaattcccaggagtgtgttgtatgacaacaagaccggaacccatttactacagtggcctgtggaagaagtggagagcttgagactgaatgctacagtgtttaaggatgttgtagttgaagcaggatcagttgtgcccctcgacataggcaccgctactcagttggatatattagcagagtttgaaatagagacgttggtattgaacagcacggaggatgaagtcagtgattgcggtgatggggcggttgataggagcacttacgggccatttggggtcctggttattgctgatgattcactttctgagctcactcctatatatttccgtccacttaatacatccgatgggagtcttgaaacttacttttgcgctgacgaaacaaggtcttctaaagctcccgatgtcacaaaacgagtgtatggaggcaaaattccagtgcttgacgatgaaaactacaacatgagggtattggtggatcattcagtagtggaaagttttggaggaggagggaggacggtgataacatcaagagtgtatccaacggaagccatatatggagcagcacggctgttcttgttcaacaatgcaagtggagtgaatgtgaaggccacactcaaaatatgggagatgaattctgcctttattcgtcctttcccatttgaagaaacattatttcaggaaatggttgcttccacatgattatca

SEQ ID NO: 876 - DNA, 560 bp, Gossypium hirsutum
cccgggtgatggaactgagcattcagaaaatagaagccttgattaggctaagtacgatagtgatgttggttttaacagcttgtttaattgggttggattctcaaacaaaggtcatcttctacgttcaaaagaaagcttctttcaaggatttgcgtgctcttgttggattgctgtatatcacttcattggctgctgcttataatctacttcaactatgctgttcttcattctcagcttcttacaaaggaacctcgctgcaatcttacgcatatctggcttggcttcgttatattttggatcaggcagtagtgtacgcagtgtttgcgggaaacctagcggctttggagcattcatttttggtattaaccggagaagagaacttccaatggctcaagtggtgcaataaatatactcgattctgcacccaaatcggaggatccttgctctgcggcttcgttgcaagcttactaatgttttccatcgcttccatctccgcattcaacttgttcaggctgtattcccccaccaagttcatgcacttgaaactctaatcagagctc

SEQ ID NO: 877 - DNA, 1464 bp, Gossypium hirsutum
cccgggttgttgtcatggcttctctgcctttcatcttcttcttatctttctttataatctccacaacattgacgtcagccggcgccgccgccgccaccatcaaactctccctctctcccttccctcacccttcttcctcccatccttaccaaattctcaacaacttagtcacttcttctgttgcaagagcccaccacctcaaacatcccaaagccaaggccgataatactacctcttctcttctcagggctcccctattttctcacagttatgggggctacactatctccctcaaatttggaactccgcctcaaacccttcctttcgtcatggacaccgggagcagcctctcctggttcccttgcacctctcgttacctttgttcccaatgcgcattccccaatgttgaccctgcaaaaatccccacttttgcccctaaactttcatcttccagtaagctcgtaggttgtagaaaccccaagtgtagttggctttttggccccgacgttgagtctcgttgccaagactgtgaacccacttccgaaaactgcactcaaacctgccctccttacataattcaatacggtttaggttccactgctgggcttctattagtagaaaaccttgctttcccccagaaaaccttccaagatttccttgtcggatgctccatcctctccaaccgacagcccgctggaatagccgggttcggtcggagcgctgagtctataccctcccaattaggcctcaagaaattctcttactgtctcgtttctcgccggttcgatgacactggcgtcagcagcaacatgttgttggaaaccgggtcgggttccggtgatgccaagaccccaggccttagctacacaccgttttacaggaaccaagtggcttcaaacccagttttcaaagagttctactacgtaactctacgtaaaattctggtgggcgataagcacgtcaaagttccgtacagttatttggtcccaggatcagacggtaacggtggcaccatagtggactcgggatcaacattcacttttatggagagaccagtgttcgaggtagtctcgaaagagttcgagaaacaaatgggaaattatagaagagtgcgtgaaatagaaaacagatcgggtttagccccatgcttcaacacttcgggctatacttcaatagaaatccccgaattgagtttccagttcaaaggaggagccaaaatggcattgcctttggttaactatttctcatttgacggtgatgataaggttgtgtgtttgatgatcgtttcaaacaatgtggtcggccaaggctcacacagcggtcctgcaataatactagggagctttcagcagcagaattattacatcgaatttgatatcgcaaacaataggtttggatgggctgaacgaagctgtgcgtgagctgcactttgttattttgtgttttggccatgaatatgagctc

SEQ ID NO: 878 - DNA, 1402 bp, Gossypium hirsutum
cccgggaaaggaaatggcaggcgtcgaagcagggaaggaggaggaggcgaccgctgtgagaatcaccggaaaaagccacgtcaagccgggtaagttgataggaagaaaagagtgtcagttggtcacatttgatctcccctacctggctttctattataaccagaagctgctgttttacaagaacgacggtggtggtgagttcgaggacaaggttgaaaagctcaagggagggctgagggtggtgttagaggagttttatcagctaggaggtaagctcgggaaagatgacgatggggttcttagagttgattatgacgatgatatggatggtgttgaagtggtggaagccgtggcagaggggattaccgtcgatgaattgaccggtgatgatggtacgagctcatttaaggaattgataccttttaatggcgtcttgaacttggagggtcttcacaggcctcttttgtccatacagttgacgaagttgaaagatggtgttgcaatggggtgtgctttcaaccatgccatcctcgacggaacctccacttggcattttatgagctcttgggctcaaatctgtaacggtacttcgagctccgtcgttgtgccgccgtttcttgatcggaccacagctcgaaacacccgcgtgaagctcgacctcagtccggttgtttcctgcaacggcgacgacgccaccaaacaaggccagccggcgccgcagatgagggagaaactcttccgtttttccgaagccgccgtcgataagatcaaatcgagagttaattcaaccccaccaccgtccgatggctctaaaccgttctcgactttccaatctctagctgtccacatttggcgacacgtatcccaagcacgtaaccttaaacccgaagactacacggtttttactgtcttcgccgattgtcgtaaaagggttgatccaccgatgcccgacagttacttcggaaacttgattcaagccatcttcaccgccacagcggccgggttgttattggaaaacccaccgtcattcggagcttcagtgatacaaaaagctatagaatcccacgacgctaaagccatcgatgaacgtaacaaggcatgggaagcagcgccgaagattttccagttcaaagacgccggtgtcaactgcgtagcggtcggaagctccccgaggtttaaagtttacgaagtggatttcgggtggggaaagccggtaggggtgaggagtggatccaacaacaggttcgatggaatggtgtatttgtatcaagggaagagcggtggccggagcattgacgttgaaatcaccatggaagctcaagctatggagaaattggagaaggataaagagtttttaatggaagtatagtattttgcatggaagtagggtactgtggatctc

SEQ ID NO: 879 - DNA, 1480 bp, Gossypium hirsutum; identical to SEQ ID NO: 843

SEQ ID NO: 880 - DNA, 720 bp, Gossypium hirsutum; identical to SEQ ID NO: 844

SEQ ID NO: 881 - DNA, 973 bp, Gossypium hirsutum
cccgggtccctattgcatgcctttcaatttgatttcatggatgtaacaagcacaccaaatagaaaagaaatggatcggatcaaaggtccatggagccccgaagaagatgacttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcatcttcttacgtgtacaagccgatcccaaggaccggcggtgttaacgttgatgtaaatgttacgccagctggagtggaagcggcatcatcttccaacgatccaccgacctcactgagtctgtctttaccgggggtggagtcatgtgaggtggtgtcaacccagccaataacggagtcaactcagaatcggagtgaagaaaggggaggtggggtgatgggtttcagtgcggagtttatggcggtgatgcaagagatgataagggttgaggtgaggaattacatgacgcagatgcagcaacagcagcagcagcaaaacggcgcagttccgggaggagcgggaatggggatgtgtttggatggggggttcaggaatcttatggctgtgaacccagtcgggatgagtaagatcgagtgagctc

SEQ ID NO: 882 - DNA, 1861 bp, Gossypium hirsutum
cccggggatagagagatgggaggtccaccgtacgattgcttggcgaatcccctaggagccgtccgattaacattcgagaaggcaatatggtcagaatcggagactcctccgatccatccctccgcctttaacggcaaagattggggtgcccttgaactcttccgccacttcctcttccaaggatcagggctttcccaggttcccatccttaatcccaaaacattaagatgggttcaacccaacagtcttgtacgttaccgtggtatgatccaagacatgttgggaaatgaattctatgccggcgcttacaaggatggaaatttatggcggaccaacaaattcatggatgtttctcaatacccaatgggttcctctcctgatatgtgtatttgggaacgccgcttgctctactgtgttcctgtcccaggacagaattcatggactgaaccttctagtgaaatggaacctaattggtcatctcaaaccagggagaagcggcgtaggatggatgacgaagataatgatcccatggatttggttcctgatgatgagattaaaagctctccaattaccaagaagatgagagaagatggacttccttccccttcacaatccagggatactaaaactacaagctcttcttctatcacaagtacatttcaatctgttgacgaagataaccttccttgcctagtcaagatatatgattctccagaatcagaattgaagctgaatgatgtttttgaatttattggggtcctcacttttgattcagagcttgcagttgagaaagatgacaatgatgagttatcaaatagtttctatgatgatgccctggtccatttgccccctaataaggtccctcgcttgcactgtcttatacataggaagcttgcagtgcaggactttctgccaggttccccaataatagagccaaagccacatttggtgaaagagacaagggaagctctgttcaggcatcttacggctgttcttggaaatgatgaggtagctgctcatttcgtgttgttgcatcttctgtccaaggttcatgctcgagtagatgatgttgcagtggggaagctgtcactcaatctaacaggtttaaacaaagaaagtgtatctgtgtttggtactcgacttagtgatacattcaaaaacctcctaccattcacgaattgcatgcctctcacactggaatatctgaacattgcctcgcttgccccgcaaaaggattatcaagccaacagattggttcctggcgttcttcagctacccgagggctcacacttgatggtagacgagacccgactagaatcaggaagcctcaattctactggaattgagaatacaaagttgctgaaaaatctcatcgagtttcaaaaagtggagtatgactttcaatactataaagtggaaatggcaacggatgtccagttacttatcttctcggaggggaaatctaatattgttcctgctgatgttattgtaccttttcaaccttcttgtcttgaatccactgaaatgccagttgctgaggcactagaagcttggagatggtacttggctactgttagatcattaccacattccattggatcagaaatacagaaggtggtagaagatgatttggttgcagcaagacaaatggatcggagcttgggaagtcgagattttagcagatggttgacgatggctcggctcatatcgtcaagtttcggagaaaccagtttgtcaaaggaacattgggaaatggccaaagaaatggagaggctaaggagggagagactgaaatagaatccaaaagtccacaagattttgaagctttggtatttggtaaatgattgttgccccagagctc

SEQ ID NO: 883 - DNA, 2024 bp, Gossypium hirsutum
cccgggcatctgatctaattgttggtggacacacacacacacacacacacacacacatacatgtagcttttagctttgaaatgtctactggagttcaacatcaagagagagtaccaatgaacctgaagaaacaacttgctcttgctgtgaggaacattcaatggagttatgcaattttctggtccatatcaactagacaaccaggggtgttagaatggggagaaggttattacaatggagatataaagacaaggaaaacagttcaatctgtagaactcaacactgaccaattgagtttacagagaagtgagcaactgagacagctttatgagtctctttcagctggtgaaagcagtcctcaagctaaacgaccttcagcagcattatctcctgaagatcttactgatactgaatggtattacttggtttgtatgtcatttgtattcaacattggccaaggattacctggaagaacattgtctactggtcaacctgtttggctttgtaatgctcattgtgctgacagtaaagtgtttggtcgttcactactagctaagagtgcatcgattcagactgcagtatgctttccgttttcaggaggtgtggttgagctcggtgtgactgatttggtatttgaagatttgagcctcattcagcgcgttaaaactttgctcttggatgatccacagccgattgtttctaagagatcgattcaagtcgatgggatgaacaacgatcttgcttgtccagctcttgatcctttgatccttgccaccaaattgagtccaatattaggctgtgaacaactagaaacggtttctcctgatgatagtccggacggcttggagcctaagcaatcaagagaagattcattattgattgaagggataaatggtggagcttctcaagtacaaagttggcaattcatggatgaagagttttgcaattgtgttcaccattccttgaattcaagtgactgcatatctcaaaccattgcggatcatcgaaaggtcgttcctctttaccggggagaaaatgataatggtttgcaagatgttgaagagtgcaatcagactaaactaacatcttttgatcgccaaaacgatgatcggcacttccatgaagttctctcggccttattcaagagctcacacccgttgattttaggaccacagtttcgaaactctaacaaggaatcgagctttatcagatggcagaaaaatggcttggtgaagcctcaaaaagaaagagatgaaacccctcaaaagttactgaagaagatattgttcttggttcctcatatgcatgatagaggattgattgaatctcctgaaactaatgctgttcgagatgcagcttggagacccgaagctgatgaaatttgcggaaaccatgtgttatcggagaggaagcggagggaaaaaataaacgaacgacttatgatgttgaaatcacttgtccctgcaaataacaaggctgacaaggtttctatactagatgtcacgatagaatacttacaaaccctcgaaagaagggttgcggaattggaatcttgcagaaagtcagaagcaagaacgaaaatcgagcgaacatcagataactacggcaataataaaaccaacaacggaaagaaatcgtccctaagtaaaaggaaagcctatgatgttgttgatgaagctgatcaagagatcggctatgttgcatctaaagacggttcaacagataaagttactctcagtatgaacaacaaggagcttctaatcgagttcaagtgtccatggcgagaaggaattttgcttgaggtaatggatgcattaagcattctcaatttggattgccactcagttcagtcatctaccactgaggggattctctccctgaccataaaatccaagtacaaaggatcaagtgttgcaaaagcaggaccaatcgagcaagcattgcaaagaattgctagcaagtgttgaagctatttgttctagattttaccagtttcttttgtaagatcccatgtcataaggtgc

SEQ ID NO: 884 - DNA, 398 bp, Gossypium hirsutum
cccgggtacaaacatggctagttccggtgtccttaagttggtttccatgattctcatggtgtgcatgacgatgatgagtgcacccaaggcagccaaagccgccatcacgtgcagcgacgtggtgaaccacttgatcccgtgcttgtcctacgtacaaaacggcggtacacccgctgctgcatgctgcagtggggtaaaagcactctacggcgaggttcagacctccccggaccgccaaaacgtgtgcaagtgcatcaaatcggcggtgaacggaattccgtacaccagcaataacctcaatctcgcagccggcctacctgctaaatgtggtctccaactcccttacagcatcagcccctccactgactgcaacaaggtgcagtgaggttgatgagctc

SEQ ID NO: 885 - DNA, 1027 bp, Gossypium hirsutum
tctagatgaaggttctctccccaattcttgcttgcctagcgcttgctgtggtggtaagccatgctgctctctcacctgagcaatattggagctataagctgccaaatactccaatgccaaaggctgtcaaagaaattctacatccagaactgatggaggagaaaagcacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgttggagacccttttaattacctatatgcagccagtgaaactcaaatccatgaagacccgaatgtggctcttttctttctggaaaaggatatgcaccccggggcaacaatgagcctgcatttcactgaaaatacagagaaatcagctttcttaccttatcaaactgcccaaaaaataccgttttcatctgacaagttgccagaaattttcaacaagttttcagtgaaacctggatcagtgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctgacggaacaaaagccaaagcagtagcagtctgccacacagatacatcagcatggaaccctaagcatttggcttttcaagtcctaaaagttgaaccaggaaccattcctgtctgccatttccttcctcgggatcacattgtttgggtccctaagtaaaaatcctggagctc

SEQ ID NO: 886 - DNA, 942 bp, Gossypium hirsutum; identical to SEQ ID NO: 845

SEQ ID NO: 887 - DNA, 627 bp, Gossypium hirsutum
cccgggagaaagatgatgaaaaggggttttattgttttggccttgacggtggttttcgccgcgacggtggttacggcggctgacgagagtgggttagcgaatgagtgcagcaaagatttccagagcgtgatgacttgcttaagctttgctcaaggaaaagcagcgtcgccgtcgaaggagtgttgtaattcagtggcggggattaaagagaataaacccaaatgtttgtgttatattttgcaacaaacacaaacttccggtgctcaaaatctcaaaagcttaggtgttcaagaagataagctgtttcagttaccgtcggcttgtcaattgaagaacgctagcgtcagtgattgcccaaagcttcttgggttatctccgagctcaccagacgccgccatcttcaccaactcctcctctaaagcaacgacacccagtacttcaacaaccaccgcaacgccgtcttccgcggccgataaaaccgatagcaaatccagtggaatcaagcttggtccccacttcgtcggttccacggcggcgctactggttgctacagcggccgtgtttttccttgtattcccagctggatttgcttcaatagtttaggggttttgcatgggatttgatatc

SEQ ID NO: 888 - DNA, 2012 bp, Gossypium hirsutum
cccgggcggcaacttaaaagaaaaccttttctttcctcattgttttactactaaaatcccataatgccggtcgtggattttgtctgtgtttttttagtttcagttgtgatgtttaatttgagagtaagcacagaaccagttgaagacaagcaagctctacttgctttcatttcgggaattagacatgccgaccgggttaaatggaattcatcgacctcagcctgtgattggttcggtgttcaatgcgacgccaaccggtctttcgtctacactttacggctccccggtgcggcccttatcggttcgattccgcccaatacaatcggtcggttgaaccgacttcgagttttaagtctacgagcaaaccgtttgtccggtgagatccctgccgatttctacaatttgactcagctgcgtagcctttatttgcaaggtaacgagttcaccggtccgttcccacctagtgtgactcgtttaactcgtttgactcgccttgatctttcttctaataatttcaccggtccaattcctttgggtgtcaacaatttgactcagttgaccagactcttcttgcaaaataacaagttttccggttctctcccgagcatcgactcggacggtttaaacgatttcaatgtgtctaacaacaaccttaaaggttcaatccccgactcgttatctaaattccccgaatcttcattcgccggaaacattgggctttgcggcggtccacttcggccatgtaacccatttcctccatctccatctccgactgagcccattccgcccaaaacttccggtcaaagctcgaaaagccttcccaccggcgccatcattgccattgccgtggggtcagcaattgttgcgttactgttattactattcctcattatctgcttccgtaaatggaaacggaagtcaccgaggcggcagaaggcgataccatcgacgacacatgcagttccggtggaggaggcggggacttcctcgtcgaaagatgatataaccggaggctcaacggaaatcgaaaggatgatgaataataagctcatgttcttcaaaggtggcgtttacagtttcgatttggaggatttgatgagggcgtcggctgaaatgttgggaaaaggcagcaccggaacgtcgtacagggtggttttagcggtggggacgacggtggcagttaaacggttgaaagacgtggcggttagtaaacgagagttcgtaatgaagatgggaatgttgggtaaaatcatgcatgaaaacgtggttccgttgagagctttttattattccgacgaggagaaattgctggtttatgattacatgcatggtggaagcttgtttgcgctgcttcacggtagcagaagctcggctcgtacaccgttagaatgggacccccggatgaaaatagccctaggcgtggctagaggcctcgcgcacctccacagttcacaaaacatggtccacggcaacattaaatcttccaacatccttctccgaccagaccacgaagcctgcatctcagagttcggtcttaactctcttttcaacaccaacactccacctagtcgcatcgcgggttaccaagcacctgaagtaattcaaacccataaagttacggtgaagtcagacgtttatagtttcggggtgttattattggaattattaaccggtagggcaccaatccaaccatcaataactgaagaagcgttcgatcttccgcgttgggtccaatccgtggttcgggaggaatgggcggccgaggtgtttgacgcagagttaatggcataccacgacatcgaggaagaaatggtgcaagcgttacaaattgcaatggtttgtgtctcgacagtgcccgatcaaagacccgtcatgtcggaagtggtacgtatgatcggagatatgatagatagagggggaacaaatgacggtacggcagccgccatatgatccgttaaacaatgaaacaaaattcaaagtgtgttgaccttgagaagccaacaaaggagctc

SEQ ID NO: 889 - DNA, 1566 bp, Gossypium hirsutum
cccgggactgtaaaaaagcataggttcccaatgcagatcctcccgtttcgaggaggcgcacttgtgtgcttcattgcttccttgttatttgttgccagtttttgcaatgccgatgctaaaacagtcgaggttgtcggggctggtgagtgtgcagattgtgcagagaataacttggagattagccaggctttttcagggctacgagtaagcatagactgcaagcccgaaaatgggaagaactttaaaacacgaggatcaggggagcttgataaacaaggcaattttaaagtattcgttccagaggatttggttgaaaatggggaactgaaggaagaatgctatgcacagcttcacagtgtatcggcagcaccttgtcccgcccatgatggcttggagtcggccaagttagtgttgaagtccaggagtgatgggaaacacgggtttgggttaaaaggaaagctcagattctcacctctaacctgtgcttctgccttcttttggcctcactttaagtttcctcccttgcctaagtggaaccatccccctttgcccaagtttccacttcccccattcaaaggcttccaccaccattatccaataatccctcccatctacaagaaacctcttccgccaccgtccccggtgtacaagccccctccagttcccgtaaacccacctgttccaatctataaacctccaccagttccagtctataaacctcctccagttccagtaaaaccacttcctccacctgttccaatctacaaacctccaccagttgaaaaaccacatcctccacctgttccagtctataaacctccaccagttccagtatacaagaagccatgtcctccaccagttccagtctataaatctcctccggttccagtatacaagaaaccgcatcctcctccagttccagtctataagaaaccacatccacctccagttccagtatacaagaaaccatgtcctcccccagttccagtctataaatctcctccagttccggaaccacatcctccgccagttccagtctataagaaaccacatccacctccagttccagtatacaagaaaccatgtcctcccccagttccagtctataaatctcctccagttccggaaccacatcctccgccagttccagtccataagcctcctccagttccggtatacaagaaaagagtccctcctccggttccaatctacaagccccctccagttcctgtatacaacaaaccactacctcccccggttccagtgtatacgaagccacttccaccacctgttccaacctacaaaccaaaacccctccctcccattccttacaagccactccctccacttcccaagatccctccattccctaagaagccatgccctccccttcctaagctacctcctcttcccaagattcctcccaagtatttccaccaccaccctccccttcctaagctacctcctctccctaagattcctcccaagtatttccaccaccatcccaagttcggaaaatggccttctttgccaccctttgctccccatcatccttaagctgagctc

SEQ ID NO: 890 - DNA, 689 bp, Gossypium hirsutum
cccggggatggtgagaggcaaaattcagatgaagcgaattgaaaatgcaacgagccggcaagtcaccttctctaagcgacgaaacgggttgttgaagaaggcttatgaactatatgttctatgcgatgctgaagtagctgtcatcatattttctcataaaggaaaactctacgagttctcaagttccgacaacatgcaaaacaccatagaacgataccgtcagtacaagaaagatgtccagagtaacatccctgaatttgacagatacacacagcaactaaggcttgaagcagaaaatatggccaagaagattgagttccttgaggtttctaaaaggagaatgttgggtcaaaatcttggttcttgttctatagatgaacttcaagaggttgaaaaccagcttgaacgcagcttaagaaacattagggcaagaaagggctatttattcaaggagcagatactgcaactaaaagctaaggaaagatatatgcaagaggagaatgccaagttatctgctaagaacaatggtacaacatgcagccagcagaacgcggaggtggagacagaactgttcctcgggttgcccgaaaaccgctgttcctagcaggtaggtctttggatatggaatgaaaatgatattccctattggaataatgcttgcttgtacgttatcgccattgctagagctc

SEQ ID NO: 891 - DNA, 1432 bp, Gossypium hirsutum
cccgggttccatgaaaagggtctcgaacatctatatagaggcaaagaaacatctctctgatctgctaacaaacgaggatcaaaatgaggatcttttgagtacacaggttccaaaaaccttaggtaggattctttctcttcctgagtataatacatcccctgtcagcagccctggtcagaacttggagcatagttttacaactgcgcatatgagatttgcaggctcggacaaattgcaaatggtgagtgaaaatgatcggtttgtcagccttctaagtatgagggcagagaagaccgatggccagctttgcatttctgaaaacaaaagcgataatgaagttgaaagtgataatgcaatttcaaacaaccttgacactagtgtgaataatgacaaagaggatccaattttttgttctataaaagatgaattgagttccaaagagtctgtgagtattgttaaagctactgaaatgatggttcatgaagaaagcaagtccctggatatttcttcagagacgagcggctcttcaattatcacagatgataaaaatgttgacatatatgaagtttgtgatgaaaaacaaaatccttggtacttgaaacaggattcatcggaagtggaccaacagcctttttctccattatcatctccatcagactcatcagtcatgaaaaaggttgaatgtttggagagtgttactgatataccagagcgatcaagccccgtatctgttcttgagccaatatttgcagatgatcttatcagccctgcaagcatcagatcttattccggtgaaacatccattcaaccgctaagaattcgattcgaagaacatgactctttggccacaaatcagagcaatcgaattaaaacttgtatgaatgataaggaatcaatatttgagcacataaaggcagtgctgcaagcctcgagtttcagctgggacgaagtctacatccggtcactttcttcagacctgcttatcgacccattgttggttgacgaggtcgaatacttgcccaaccagctttgtcaagaccaaaaactgctctttgattgcattaatgaagtagtcagagaggtttgtgagtactattttggttcccctagtgtttcatttgttaaacccaatatccgtcctatcccaaacatgcaaaatacaattcaagaagtctgggagggagtttattggcatttgctcccgactccattgccttgtactctggacctggtagtccgaaaagacctggctaagactggaacatggatggaccttcaacttgacactggttatattggtgttgagattggtgaagccatcttcgaagatttagtggaagacaccataacaagctacataaatggaagttgggaatgtgaatataatgtgcttccagcttagcttagctgaaggacaacgacgatagagctc

SEQ ID NO: 892 - DNA, 1143 bp, Gossypium hirsutum; identical to SEQ ID NO: 842
  misc_feature (24)..(24): n is a, c, g, or t

SEQ ID NO: 893 - DNA, 32 bp, Artificial sequence
  Single strand DNA oligonucleotide
gacccgggaaacaatgagtaaaggagaagaac

SEQ ID NO: 894 - DNA, 39 bp, Artificial sequence
  Single strand DNA oligonucleotide
ttgagctctcatcaggttgacttgtatagttcatccatg

SEQ ID NO: 895 - DNA, 23 bp, Artificial sequence
  Single strand DNA oligonucleotide
gcgggactctaatcataaaaacc

SEQ ID NO: 896 - DNA, 20 bp, Artificial sequence
  Single strand DNA oligonucleotide
caccttcaccctctccactg

SEQ ID NO: 897 - DNA, 28 bp, Artificial sequence
  Single strand DNA oligonucleotide
ttcaagctttttttgtttgttgtggggg

SEQ ID NO: 898 - DNA, 28 bp, Artificial sequence
  Single strand DNA oligonucleotide
ggttaagcttcgacggccagtgaattcc

SEQ ID NO: 899 - DNA, 20 bp, Artificial sequence
  Single strand DNA oligonucleotide
ggaccactgtcggtagaggc

SEQ ID NO: 900 - DNA, 22 bp, Artificial sequence
  Single strand DNA oligonucleotide
ttctctaagcttgcatgcctgc

SEQ ID NO: 901 - DNA, 28 bp, Artificial sequence
  Single strand DNA oligonucleotide
ggttaagcttcgacggccagtgaattcc

SEQ ID NO: 902 - DNA, 20 bp, Artificial sequence
  Single strand DNA oligonucleotide
acggagtcaactcagaatcg

SEQ ID NO: 903 - DNA, 23 bp, Artificial sequence
  Single strand DNA oligonucleotide
tgcattattcaaaccctgtctcc

SEQ ID NO: 904 - DNA, 21 bp, Artificial sequence
  Single strand DNA oligonucleotide
tctctaagcgacgaaacgggt

SEQ ID NO: 905 - DNA, 810 bp, Gossypium hirsutum
cccggggctagctcttactcaaatggcaaccaaaacgatgatgttgcaaatatttccacttttcttctttttgttcagtgtctgcaactccattttccttggtgctaatggagatgacaatggtggttggcaaactgcccatgccaccttctacggtggtgctgatgctaccggcacaatggggggagcttgtggttatggaaacctgtacagtcaagggtatggaacgagcacagcagctttgagcactgcacttttcaacaatggcttgagctgcggtgcctgctacgagctccggtgcaacaatgatcctcaatggtgcattagtcgaaccataaccgtgacagccaccaacttttgtccacctaactatgctttatctagtgacaatggcgggtggtgcaatcccccacgagaacactttgatttggccgaaccggcattcttgcggatagcagaatatcgagctggaatcgtccctgttatgttcagaagggtgtcatgtgtgaagaaaggaggcatcaggtacaccatgaatggacattcgtacttcaacatggtgttgataacgaacgtgggaggggcaggggatataacgtcagtgtccatcaagggttccagaacaggatggctacctatgtccagaaattggggccaaaactggcagagcaatgcttaccttaacggacaaagcctctcttttaaagtgactgccagcgatggcaggactatcacagcctacaatgtagtgcctgctggttggcaattcggacaaacttttgaaggaggccagttttaagacaagatatc

SEQ ID NO: 906 - DNA, 752 bp, Gossypium hirsutum
accaccatcaaaccacatcccacagacatgggtgcccacgaagaagaagccggaggtgaagagtacttgtttaagatcgtgctgatcggtgtctcagctgtgggaaaatcgaaccttttgtcacgttttgctaggaacgagttcgacaataactcaaaggcaactattggagtagagttccaaacgcaatgcgtggaaattgatgggaaagaagttaaagcacagatctgggacactgctggtcaagaaaggtttcgagctgttacttctgcttactatagaggagctgttggtgctcttattgtttatgatattactaggaggagtagctttgacagcattaaacgttggcttgatgaacttaccactcattgtgaaactacattgacaagaatgctggtggggaacaaatgtgatttggagaacataagagatgtaagtgtggaggaaggcaaaagcctcgcagaggaagaaggcctgttcttcctggaaacgtctgccgtcgaatctactaacgttcagactgcttttgagatcgttatccgggaaatctacaacaatgtaagccgaaaagccctaaactctgattcatataaaggtgagttgtctgggaataaagtcaccctagtcaaggatggggcaaatgcttccaagacgggtttctcctgctgtgccagatgatctctggtccctccatattgcagagaagccacctgtttccactcttctaatcctggtgtgtcaattttgga

SEQ ID NO: 907 - DNA, 1157 bp, Gossypium hirsutum
ttccctttccaagcttcagcaagccagatatggctcaaaatatggccaggagaagggttgttttggtgcagattttggcactagccttggccgctgttatgccattgctctcaggaggtgtggatattcaacaagttagggtgctggcagctaaattcaacgtgacttgcgtagtggtattcggagactccagcgtggatccaggcaataacaactatattgctacgccctttaagggtaatttcctaccgtatgggaaagacttcttcagaggccacccgactggacggttcagcaatggaaggctagccactgattttattgctgaagctttgggttacacgaacgaaattcgacctttccttaacaagagattgagaccagttgatatcttgcatggtgttagtttcgcatcagctgcttctggttatgatgagctcactgccaatctctcacatgtcctgccggtttccaagcagctagagtatttcagggaatataagatgcggctgaggcaactggttggagcgaggaaagcagaaaatattataaaaaatgcggtagctgtgatgagtatgggcacaaatgactttcttcaaaactactatttagaacccattcgccccaagcagtatactttggaagagtaccaaaattacttggcttcttgcatgtctgacgatgttaagacgatgcacagtcttgggataacaagattagtggtagttggggtgcctcccctggggtgcatgccccttgtcaagactctaatgaaccaggaaacatgtgtggaaaagtataacaatttctcctcctccttcaattccaagctacaattcaagttggaagtcgccaggacaacattagggatgaaaattggctacgttgatgcttatggcatctttgaggacgctgtcaataactccaaaaaatatggtttcattgaagcttcaaaagggtgttgcgggacggggaccatagagtatggagatacatgcagaggcatgagtacatgcgctgatgcgtcaaaatatgtattctgggatgctgttcatcccactgaaagaatgtatgaaataatcgctgggcaggccattgattctctccggaaacagctgatggcctagctagaagcctgcaagctgcaactttaggta

SEQ ID NO: 908 - DNA, 1546 bp, Gossypium hirsutum
ttgcctttttgtcatttcccttaattaattgtctcttatggagtcgttctcttttttgttgataatttcaattttctatcttctcttcaaaatatggaattggatcaataacgtgagagaccaacaatgttacattttggattaccaatgctacaagcccagtgatgataggatggtggggactgagttctgcggggaagtgataaagaggaacaagaatctcggactcaacgagtacaagttcttgctgaaagccattgtcagttcaggcatcggagaacaaacctacgccccgaggatcatgttttccgggagagaagagagcccgaaactggaagatgggatcttggaaatggaagagttttttcacgatagcatcgagaaggtgttatcaagggcaggcatatctcctcaagaaatcgatctcttagtcgtcaatgtctccatgttatccacagttccttctttgtgttctcggatcataaaccactacaaaatgagaccagacatcaagtcttttaacttaactggaatggggtgtagtgctagtctgatttctcttgacattgttcgcaatgtcttcaagtcttacaagaacaagttcgcattgcttgtgacttcggaatcgttgagtccgaattggtatgctggcaacgatagatcgatgattctctccaattgtttgttccgttcgggtggctgcgcagtacttttgacgaacaagaagtccttgaagcatcgagcaatgttcaaattgaaatgcttggtgagaacacatcatggagccaaagatgagtcgtatggttgttgtatccaaagggaagatgataaaggaaggatgggatttcaccttagcaaaagccttcccaaagccgcaactcgttctttcgtcgataatttgagggtcatcaccccaaagatcctgcctgttagggaactagtccggttcatggcagtttcactccttaaaaaatggaacgtcgtccgccatggttcttcccacaagggagcttctcaaggaccaatcaaagctggggtgaacttcaagagtggggtggaccatttctgcatccacacaggagggaaagcagtgatagatgggatcggaataagccttgatttgaccgagtatgatttggagccagctaggatgacactgcatcgatttggcaacacatcggcaagtagcctgtggtatgttttggcatacatggaagccaaaaagaggctgaagaaaggggataaggtgttgatgataagctttggtgctggctttaaatgcaacagttgtttgtgggaggttgtaagggatttaggagatgggaatgtatggaaagatgaaatttacatgtacccaccaaagacattggttaatccttacatggaaaagtttggctggattcaagatgaagatcctagcaccttcaatcccggagattaaaagtctattaaggtaaaaataaaatatctaaatttgatcattgtatttctttgtatacagtcaagttcttaagattgttaaatcccaaagtggattcataaacaa

SEQ ID NO: 909 - DNA, 1304 bp, Gossypium hirsutum
aaacgatggaggatcttgccgtcgataagattgtcaatattggtatcggattagtgccgccggagatggctgatcaactttatgaaggaattcattctcatttggaaaatgttggaattgacggagttaaagttgacgtgattcatctgttggaaatgctgtgtgaaaactatggtggaagagttgatcttgcaaaagcttattataaagctttaacagattcagttaaaaagcatttcaaaggcaatggtgttattgccagtatggaacactgcaacgatttcatgtttcttggaacagaagccatttgtcttggtcgtgtcggggacgatttttggtgcactgatccatcaggtgaccctaatgggacattttggctccaaggttgtcacatggtgcactgtgcttacaacagtttatggatgggcaactttatccagcctgattgggacatgttccagtcctcccacccttgtgctgagttccacgctgcttcaagggccatctccggtggcccaatttacatcagcgacactgttggcaaccacaactttgctctcctcaaacgcctcgttttacccgatggttcgatcctccgctgccaatactacgctcttccaaccagggattgcctatttgaggaccctctccatgatggcaaaaccatgctcaaaatctggaacttgaataagtatactggtgtgattggcgcatttaactgccaaggaggcggatggtgccgagaaactagaagaaaccaatgcttttccgagttttcgcatacggtaaaggccgagatgaatccaaagaacattgagtggaacagtggaaagaacccaatttccattgaagatgtccaagtattcgccatgtatttttctcagtccaagaaactagtcctctcaaaaccggctgaaaacatggaaatctcgctgaaaccattcgatttcgagcttataaccgtatcgccggtcactgtgtttggtagaaaatcagtccaattcgcccctattggactagtgaacatgctgaatgccggtggtgccatccagtcattagcctacaatgaaagctcagttcgaattgaattgaagggagccggtgaaatgagagcctttgcttcgaacaagccgacagcttgcaaaattgatgggaaagatgttgggtttgagttcgagaacaacatggtcattgttcatgttccatggccagctccttctggtttatccacattagagtatctgttttaagttactgacttattgacttcgtagaataactctgtaatgacatttcaattccaa

SEQ ID NO: 910 - DNA, 885 bp, Gossypium hirsutum
cactcttcattcctcacctactctctgcaaaaatggcaaggaaaattgtgctcattctggtactgagatgcctctgcattgggctagcagctgctgactggaacatcttgaacccaatatggaatatcaatgcaagacaagatagcttgaaaaactactgtgaaagttggaggatcaatgtggagctgaacaacataagggagttcgatgtagtgccccaagaatgcgttgctcacatcaagaagtacatgacttcatcacagtacgatgctgactgccagagagctatcgaggaagtgacactatacttaagccgctgttgctctttgaaaggtgatggcaaagatgcatggattttcgatgttgatgatacactcatctccaccattccttacttcaagaaacatggttttgggggagagaaggtgaactcatcttctttggaggcatggatggaagagagcaaggcaccagctctcgaccacacattcaagctcttccatgacattaaagatagagggatgaaaatctttctggtctcttcaaggaaagaaacccttagatctcctaccgttgataacctcattaatgttggataccatggatggtctaggctcttcttaaggggtttcgaagatgaatacatgcatgtggaacaatacgagtcccaagtgaggaaaacattaatggatcaagggtaccgcatatggggaatcgttggagatcaatggagcagcttaaagggtttgccagaagcaaagagaacattcaagctgccaaattccatttactacatgtcttaacttcatctgaataaatttttatgcactcattttcccacctcatgtgcttttgtatttgcttgcggttgttttcagaaatcca

SEQ ID NO: 911 - DNA, 644 bp, Gossypium hirsutum
gaactcttcaagaccattcgacaatggtgacaatccctttctttgtcctaatcatcctccttttcctctccagctccgcggccacaccaaagagcggtgcaggtcacgacctggtccgttcatcatgtgtccacgccagctatccaagcctctgttttagcaccctttcttcctactccggcccagccaacaccccacgtgagttagcccaagccgccgtaaaagtcagcctgtcccgtgcccggaaagtgtcgaactacttgtcgacgagtgtgacggggtacaacaagagggaacgagtcgcactgagtgactgcgtggagcaaatagatgagtcgatggaggagttgagcaagacattaggggagttgaagcacttgagaggggagacgttcgagtttcagatgagtaatgcgcggacatgggtgagtgcgtcgctgacgaatgaggacacgtgtcttgatgggttcgaaggagttgacggcaaggttaaatctaatgtgaagaggaagatcacgaatgtggctaaagttaccagtaatgctctgtacatgatcaataggctcaatgaaagtcgtggtaggcaccgttgaatctttgatgatgatgatgatgaataatggatggttgtgatttatctagct

SEQ ID NO: 912 - DNA, 1268 bp, Gossypium hirsutum
ttcagcgttcgaatccatgattttttccatcttcaaaagccaagtcttcattagaaatggctctttcattcgcccaacctgtgctaaaaatgtgagtttttctcgagcaattgcattgctacttgttagatatgaatctggaattgcagaaaatgaacagccgtttaagatttcttacctcataaacacaatcgggttgtctccacagtctgctttatcagtgtctaagaagctccattttgagacctctcaacaaccagacactgtgatttccttcttcaacaaccatggcttttcaagaacccagattagagacatcgttcagaaatggcctgcatctcttttatgcaaccctgagaaaacccttttgcccaaacttcaattcttttactccaaaaggatttcaggttctcaacttttaagaatcttgtcttcaaacccagatgcctttagacgtagtttagataattgcgtcatcccaaacttcaactccttcaaggaattcactcgatgtggcgacgatcaggtgtttttagcatacaagaactattccgacgtcctttcacgtaattttcaagccattgttgctcctaatattgcaatcctgaaagaatatggggtgcctgaatcaaatattatggttgaacttgttgtgcacccaagggcctatgcagtgaatcctgataagtttagtataacagttgaacaagtaaagaaaatgggatttaatccttcaaaacgtaggttccttacagctcttcaagctttcttacagattagcaaatcaacatgggaaaagaaattcgatcttcttaaccaatggggttggtcaaatgaagttgttctttcagcttttgagaagtatccgagattcatgatgttttctgagaagaagatcactacaataatgagctttttcgtccacacaatgggatggaaatcattggatatcgctaaccgtccagttattctttcgtatagcttggagaggagaattatcccaaggtgttcggttcttcaagccttgttatccaaaggtttgatcaagaaattcagtgtatgtcttgttctggagtatactgaaaaggcattcctccaaaggttcatcaccccttatgaagatccttatatattgaaattatatgagcagaagttaggcctttcagaataaatagtataattctatagttacccaagacggatatgggtatgtatcagacatgggtatgtttagtgttttaagattttgcatgtcaatgtgtcaggca

SEQ ID NO: 913 - DNA, 1456 bp, Gossypium hirsutum
gtttgaagctcaggaactaatggcgaaagataggagtggggaactcgttccttaccatcctccctttaatttggatcccgaggagggttctagtgcaactgctcgtcgatggagggatggtagcttggaggtcgatttacctatgatgcaacttaaggagctgttcaatgtcaatcatttcattgtgagtcaagcaaaccctcatatcataccatttttgagggtaaaggagtttgttcgagcccatggtggtaactttgcggcaaagtttgcgcacctaaccgagatggaagttaaacatagatgtagccaaatacttgaactgggatttcgtatggggggactagccaagatatttgctcaagattgggagggtgatattaccgtggttatgccagctacagtttctcagtacttgaaaattctacaaaacccaactcttgtggagcttcaaaaggcagccaaccaagggagaagatgcacttgggagaagctgtcagctatgaaagcaaattgcggcattgagcttgccctcgatgagtgtgttgcaattcttaaccacatgcgtaggcttaaacggagtgctgacagagctgctgccgcttcatctcatggtcttcttgccaacacaacaaccaaattcaatgcttcgaagagaatcccgtcttggaattgcattgcaagagaaaactcatcaggctcccttgaagaagaccttctcacagatgttacttcgtctttgcatcacggagtaggtagttctttgggaataccaccacctgctaggaatttacgagcccatcgcagtgcctacgatggaagtgatagtgaatcagaaggtgtagacatacattcttggacaagatctggtggtccgttgatgaggacgagttctgcaaatctgttcatcgactttgtccaaaatctagacgctgaagctgaagtgaacaaaggtctaatggctcatcctggttctcctggatttcagatatgcggtggggattcatttagtcacagtccgaggatgatgaaatcagatagaggttcagaacacgagtttgatcaaaggaattttgggaacagaccgcctgttaacggttctagcattatggtcactgaaggtgatctcttacaacctgaaaaggtcattaatggacttatgctcaacgtggtgaagaaagctgacttggcacagtcaagtcgaagccctgattcagatagttgtagtactgaagtagctgaatgtgtgcagctggagtgtccagagaaggatgatagctccgcatccgaatgtagcgacgatgatgccggtgcagtaaatgagacagttgctaccgataatctgacccgaagtgcccatgatgattatcagggtggtgttgtagatgcttaagattaatctaataccctaccaagctgttagagttaattttcgggtggcaacaaattggtccct

SEQ ID NO: 914 - DNA, 713 bp, Gossypium hirsutum
aagaatccgacccggtaacccgacatggcagcgtatagagcggatgacgactacgattatttgtttaaggtggtgttggtcggagattccggcgtcgggaaatccaatttgttgtcgagatttactagaaacgagtttagccttgaatctaaatccacaatcggtgtcgaatttgccacccgaagtattcgggtcaatgataaaatcgttaaggcccagatttgggacactgctggacaagaaagataccgggcaattacaagtgcatactaccgaggagctgttggtgccatgcttgtctatgatgtcactcgacgggtcacgtttgagaatgttcagagatggctgaaggaactacgagatcatacagattctagcatcgtgattatgctcattggtaacaaggccgacctgcgacatttgtttgccgttaccaccgacgatgctaaggcctttgccgagagtgaaaacaccttctttatggaaacatctgcccttgaatctacaaatgttgagcatgcattcactgaagtgctaactcaaatacatcaagtgatcagtcgaaaagcgctcgaaggagggaatgatcaaacaacattgcccaagggacaaaccatcaatgtcggatctcgggatgatgtttcagctgtgaagaaagacggctgctgttctgcataattgttagatgattccgagtgtccaaatttacttcc

SEQ ID NO: 915 - DNA, 1433 bp, Gossypium hirsutum
  misc_feature (386)..(386): n is a, c, g, or t
ccctaagatgacaaaccaagaaaactcagtgattgttgtgatggtgccatttccagcacaaggtcatttaaaccaattgcttcacctctctaggatcatcctctcctatggcatcccggttcattatgtcggtacatccacacacaaccggcaggcaaaggtcagagtgcatggttgggatccggtagctgtcgctagtttccatttccatgactgtcaagttcctccttttgcttctcctcctccaaaccccaatgcagcaatcaagttcccttctcatctccagccatgttttgatgcctgtcattatcttcgtaaacctgtcactgagttgttacgtatgctttcttcacaagcaagaaaggtcgttatcattcatgactctntgatgggatccgtggttcaagatgttggttcaattcccaacacagaatcctatgctttccacactgtttctgcattttctctcttcttttatttatgggaatcaacggggaaaccacaagttaacgcagaaatccttggtgaaaatgacgtcccttctcttgaaggatgcttcactgaagatttcttggagttcattgctttgcaacaccgatatctaaacgtcacttctgggagtatatataacacaagcaaagtgatagaaggtacttacgttgacttgcttcgccaacatatgaaagaaaagcaacattgggctttggggccatttaatccattaaaagtacctgagaaaagcagttgcggtagccgacactactgtttggaatggcttgataaacaggagatgaactctgttctttacgtgtcttttgttactacaaccacaatgggtgatgaacaaatccaagaactggcaattggtttgagaagaagcaatcaaaagttcatttgggtattgagagatgctgacacaggcgatgttttcaatggagaagttagaaggccggagcttccaaagggataccaagattcagtgaaagataaagggttggtggtgagagattgggcacctcagctggagatattagcccaccctgccattggtgggtttgtaagccactgtgggtggaattcatgcatggaaagcatcaccatgggagtaccaataggggcttggcctgtgcattcagatcaaccaagaaacgcagtactaatcacaaagttgctcaaactcggcattaccatcaaggactgggcacgtcgagatgaagtagtgacagcagcggtagttgaagatgctgtgaaacgtttgatggcttcaaaggaaggagatgagataaggaagagagcggcagaagtaagtggtgcggtgcgccaatcggtggctgaaggtgaggtttaccgtaaggagtgggactccttcattactcatatcattaggtaggttttatcatttattactatcaaactactgccacatgattatt

SEQ ID NO: 916 - DNA, 627 bp, Gossypium hirsutum
aaacatggaaggagacgatgtagacatggcagctgctgaatccactgaagcagatcttgatgacatgaagaaaaggttaaaagagatggaggaagaagccgctgctcttcgtgagatgcaagctaaagtcgagaaagagatgggttccgtacaagatcctgctgctgctgcagctacatctcaggcaaatcgagaggaagtggattctcgatcagtgtttgtgggcaatgtggattattcatgtactcctgaagaagttcaacagcatttccagacttgtgggactgtaaatagggttactattcgtgcggacaagtatggtcagccaaagggttatgcttatgtagagttcgttgaagctgaggctgtccaggaagctcttcttttgaatgaatctgaacttcatggcaggcaattgaaggtcactgctaagcggaccaatatacctgggatgaaacaatatcgtccacgtcggtccaacccttttatgcgacccaggggtccattcatggctccatatttctttgctccatatggatatgggaaggttccacggttgagaatggcaacgcgttacagcccctattattaggtacttggattgaactggttgttctgaatgctttt

SEQ ID NO: 917 - DNA, 1056 bp, Gossypium hirsutum
gagctctggatacagttaagaatccgatggactccttgggtccgaatcggtttgatatcttcgagatttatcggcgattctgtgaacttagaacaggatatgagcatgtttgtgatggagaaggctaccgacaaggcgaggaatcacaaagagctaagttcactagggacgcattgaaccaactcttaaagatggtggagtcaaggatgcgcgagaggcatatgaatgcaatctttgatgaacttctcaaactcatgttacagctcgacttgatggtagacttttctgtattctcgtgcttctatgattttgttttcttcgtatgccgagaaaatggtcaaaagaatattactgtaagcagggcagttgctgcttggagattagtcttagcaggcaggttccgtttgcttaaccaatggtgtgactttgttgagaaaaatcagcggcacaatatttctgaggatacatggcagcaagttttagcttttagtcggtgtgtgcatgaaaccctagaagggtatgatcctgaaggtgcttggcccgttttaattgatgactttgttgagcatatgtacagaatttcagggtcgaataaagatacaaatggtttctgtagctatggtgattcagggtcccagttgtgtgcatacgatgactctttgcccggactaaaactagttccggggttgaagaggaagttgcgtgaatgtaacaatgataaaatggagtccttggaaccattattctcgagctctccgaacccgaattgcacatcaaattccaagagaaggtttattttgtgcagatctgatgagagggaagataatcttccccagaattcatgcgatgagagcatggaaattgttaaacaaagtagtccggtgggttcttccaagtctccatgtgcagttgaaggttgcatgtcaaagggtttagcagggctgttatcttgttgctcgtattttgcagtttgattgggaaagaggagttttgctataggtagaagctccctatgtaggggaaaagaaaatggatacatgctttactacaagtcta

SEQ ID NO: 918 - DNA, 376 bp, Gossypium hirsutum
agttaactggtctcttctgatgtcttcattcacttttgtgcccacagcttgtgtttatggttcaagttggacagattggtgtcgcatatttgcatgtacaaagccaaatggacctttggaatttatgctttgtctaccagcacatggagctgtaattggagcttggtttggtgcttggcctatgccacttgattgggaacgcccttggcaggattggccaatctgtgtgagttatggagcaatggctggttacgtggttgggatggtgggatcctttggtcttgcactaataatgcatactggacgaaagcaactcaaagcagagtagatggtactctttttccgtttcagtgaagcaatgactggtatagttgtt

SEQ ID NO: 919 - DNA, 543 bp, Gossypium hirsutum
tttcgatcaccgtgatggcggcggcggctcatatagatatagagccagcaatacccgaagaagaaacgacgtcgaattcccttatacgaaacactcgttgctgcttctgtttcccttgcttcagctcccgtcgtacgcctgccgttggcttagccttttggcagcgaataggttcgtcccatgtccggtccaatactggcttctggtcctcaagtgttagagccttcaagaaggttcgagagtggtccgagatcgtcgccggcccccgctggaagacttttatcaggagattcaaccgtagcaaaagtgggagcggaatcgtctccagcggtaggcatgggcaattccattatgatcctttgagttacgctttgaatttcgacgaaggcccgcgacagaatggtaatttggaagacgataatgatttcggtgcctttcgggctttctcaacccgttacgcttctgttccgggttcggagaaaacaacattggcgtagatgacgccgaatggatcatgtacagtgaaccggtgacgtcactacg

SEQ ID NO: 920 - DNA, 886 bp, Gossypium hirsutum
agacacacaaagcgagaagggttagaatgggaaaccagaaacaaaagtggacggcggaggaagaggaggcgcttctggccggaatcaccaaacacggtcctggaaagtggaagaacatccttaaagatcccgaatttgcccctttcctcactcaccgctccaacattgacctcaaggataaatggcggaatttgagtgttagtacttctactcaaggtgccagagacaaatcaagagcacccaaggtaaaagccattgttgcttcccttcccaacactcccaattcttctgctccagttgcgttgcgtgctcacaatgtaacttctgatactgttgtgggtgattcttcaaacaacggcatagacgggaagaatgctcctaggtataacacaatgatttttgaagccctttcaaccattaaagatacaaatggatgtgatataagtgcaattgtaagctacattgagcaaaggcatgaggttccaccaaattttagaaggttactaagttcaaggctgagaagacttgtttcacaaggcaaactggaaaaggtacaaaattgctacaagatcagagaagataccttgatgggaacagaaacacctacccctaaacaaaaagacgtacgcctacggcagaattctggtgcaataggttctggtgaaacagtagaagaagcagccatcacaacagcctataaagttgctgaagctgaaaataaatcgtttttagccgctgaggccgtgaaggaggcagaaagagtctccaaaatggctgaagataccgattcaatgcttcagctagtgaaagaaatctatgaacaatgttcacgaggggaaactgttattttggtttgagtctttagctgcctaggatgtaagtgata

SEQ ID NO: 921 - DNA, 232 bp, Gossypium hirsutum
tctggcttgaaaatggtgtgcttttgtttcctagtggaccaaaggcatatgctgatgagcagcaagccggcagccgggacatgcttgcggtgccgcagcggagcaagtgtcgggctcatgaaaacggttacccgtttttgttatgtcccaatttattggaaatcttggaaggctataatctgcacattttgtggagctgttcttaaatcttacagatgatgaagttcaatgc

SEQ ID NO: 922 - DNA, 601 bp, Gossypium hirsutum
tttttccaactaaggttaggctttaaactttaaaacattatgggtttagcagcagccctcctcttcctcctcctagcagctccggcggcttttgccgagcaatacaccgtaggagacagcagcggttggacctcgaccggagattaccaaagttgggttcaagggaaaacattcaccgtaggcgacacacttttgtttacctacggtggcagccactcggtggaggaagtatccaagagcgactacgataattgcaacaccggcaatgctattaaatcctacagcgatgggaacactgtcatcacactgtccaacccaggggcaatgtatttcatttgccccaccataggtcactgtgctggtggcatgaagctagccatcaatgttgtagcagctagtggcaactcaccctccaccccctctactccgtctggttccaccactccttccgggactcccccgagtggtggtacaacaacttctcccccgtcaacacctagcggagctccgagcaccgtgaattatggttttatggtagccttgttgggagccgttgttggaattatgtgctaggggagaggcagtgctattgtttattggc

SEQ ID NO: 923 - protein, 217 aa, Gossypium hirsutum
MGAHEEEAGGEEYLFKIVLIGVSAVGKSNLLSRFARNEFDNNSKATIGVEFQTQCVEIDGKEVKAQIWDTAGQERFRAVTSAYYRGAVGALIVYDITRRSSFDSIKRWLDELTTHCETTLTRMLVGNKCDLENIRDVSVEEGKSLAEEEGLFFLETSAVESTNVQTAFEIVIREIYNNVSRKALNSDSYKGELSGNKVTLVKDGANASKTGFSCCAR

SEQ ID NO: 924 - protein, 365 aa, Gossypium hirsutum; identical to SEQ ID NO: 133

SEQ ID NO: 925 - protein, 467 aa, Gossypium hirsutum
MESFSFLLIISIFYLLFKIWNWINNVRDQQCYILDYQCYKPSDDRMVGTEFCGEVIKRNKNLGLNEYKFLLKAIVSSGIGEQTYAPRIMFSGREESPKLEDGILEMEEFFHDSIEKVLSRAGISPQEIDLLVVNVSMLSTVPSLCSRIINHYKMRPDIKSFNLTGMGCSASLISLDIVRNVFKSYKNKFALLVTSESLSPNWYAGNDRSMILSNCLFRSGGCAVLLTNKKSLKHRAMFKLKCLVRTHHGAKDESYGCCIQREDDKGRMGFHLSKSLPKAATRSFVDNLRVITPKILPVRELVRFMAVSLLKKWNVVRHGSSHKGASQGPIKAGVNFKSGVDHFCIHTGGKAVIDGIGISLDLTEYDLEPARMTLHRFGNTSASSLWYVLAYMEAKKRLKKGDKVLMISFGAGFKCNSCLWEVVRDLGDGNVWKDEIYMYPPKTLVNPYMEKFGWIQDEDPSTFNPGD

SEQ ID NO: 926 - protein, 414 aa, Gossypium hirsutum
MEDLAVDKIVNIGIGLVPPEMADQLYEGIHSHLENVGIDGVKVDVIHLLEMLCENYGGRVDLAKAYYKALTDSVKKHFKGNGVIASMEHCNDFMFLGTEAICLGRVGDDFWCTDPSGDPNGTFWLQGCHMVHCAYNSLWMGNFIQPDWDMFQSSHPCAEFHAASRAISGGPIYISDTVGNHNFALLKRLVLPDGSILRCQYYALPTRDCLFEDPLHDGKTMLKIWNLNKYTGVIGAFNCQGGGWCRETRRNQCFSEFSHTVKAEMNPKNIEWNSGKNPISIEDVQVFAMYFSQSKKLVLSKPAENMEISLKPFDFELITVSPVTVFGRKSVQFAPIGLVNMLNAGGAIQSLAYNESSVRIELKGAGEMRAFASNKPTACKIDGKDVGFEFENNMVIVHVPWPAPSGLSTLEYLF

SEQ ID NO: 927 - protein, 256 aa, Gossypium hirsutum
MARKIVLILVLRCLCIGLAAADWNILNPIWNINARQDSLKNYCESWRINVELNNIREFDVVPQECVAHIKKYMTSSQYDADCQRAIEEVTLYLSRCCSLKGDGKDAWIFDVDDTLISTIPYFKKHGFGGEKVNSSSLEAWMEESKAPALDHTFKLFHDIKDRGMKIFLVSSRKETLRSPTVDNLINVGYHGWSRLFLRGFEDEYMHVEQYESQVRKTLMDQGYRIWGIVGDQWSSLKGLPEAKRTFKLPNSIYYMS

SEQ ID NO: 928 - protein, 189 aa, Gossypium hirsutum
MVTIPFFVLIILLFLSSSAATPKSGAGHDLVRSSCVHASYPSLCFSTLSSYSGPANTPRELAQAAVKVSLSRARKVSNYLSTSVTGYNKRERVALSDCVEQIDESMEELSKTLGELKHLRGETFEFQMSNARTWVSASLTNEDTCLDGFEGVDGKVKSNVKRKITNVAKVTSNALYMINRLNESRGRHR

SEQ ID NO: 929 - protein, 384 aa, Gossypium hirsutum
MIFSIFKSQVFIRNGSFIRPTCAKNVSFSRAIALLLVRYESGIAENEQPFKISYLINTIGLSPQSALSVSKKLHFETSQQPDTVISFFNNHGFSRTQIRDIVQKWPASLLCNPEKTLLPKLQFFYSKRISGSQLLRILSSNPDAFRRSLDNCVIPNFNSFKEFTRCGDDQVFLAYKNYSDVLSRNFQAIVAPNIAILKEYGVPESNIMVELVVHPRAYAVNPDKFSITVEQVKKMGFNPSKRRFLTALQAFLQISKSTWEKKFDLLNQWGWSNEVVLSAFEKYPRFMMFSEKKITTIMSFFVHTMGWKSLDIANRPVILSYSLERRIIPRCSVLQALLSKGLIKKFSVCLVLEYTEKAFLQRFITPYEDPYILKLYEQKLGLSE

SEQ ID NO: 930 - protein, 457 aa, Gossypium hirsutum
MAKDRSGELVPYHPPFNLDPEEGSSATARRWRDGSLEVDLPMMQLKELFNVNHFIVSQANPHIIPFLRVKEFVRAHGGNFAAKFAHLTEMEVKHRCSQILELGFRMGGLAKIFAQDWEGDITVVMPATVSQYLKILQNPTLVELQKAANQGRRCTWEKLSAMKANCGIELALDECVAILNHMRRLKRSADRAAAASSHGLLANTTTKFNASKRIPSWNCIARENSSGSLEEDLLTDVTSSLHHGVGSSLGIPPPARNLRAHRSAYDGSDSESEGVDIHSWTRSGGPLMRTSSANLFIDFVQNLDAEAEVNKGLMAHPGSPGFQICGGDSFSHSPRMMKSDRGSEHEFDQRNFGNRPPVNGSSIMVTEGDLLQPEKVINGLMLNVVKKADLAQSSRSPDSDSCSTEVAECVQLECPEKDDSSASECSDDDAGAVNETVATDNLTRSAHDDYQGGVVDA

SEQ ID NO: 931 - protein, 217 aa, Gossypium hirsutum
MAAYRADDDYDYLFKVVLVGDSGVGKSNLLSRFTRNEFSLESKSTIGVEFATRSIRVNDKIVKAQIWDTAGQERYRAITSAYYRGAVGAMLVYDVTRRVTFENVQRWLKELRDHTDSSIVIMLIGNKADLRHLFAVTTDDAKAFAESENTFFMETSALESTNVEHAFTEVLTQIHQVISRKALEGGNDQTTLPKGQTINVGSRDDVSAVKKDGCCSA

SEQ ID NO: 932 - protein, 459 aa, Gossypium hirsutum
MTNQENSVIVVMVPFPAQGHLNQLLHLSRIILSYGIPVHYVGTSTHNRQAKVRVHGWDPVAVASFHFHDCQVPPFASPPPNPNAAIKFPSHLQPCFDACHYLRKPVTELLRMLSSQARKVVIIHDSMGSVVQDVGSIPNTESYAFHTVSAFSLFFYLWESTGKPQVNAEILGENDVPSLEGCFTEDFLEFIALQHRYLNVTSGSIYNTSKVIEGTYVDLLRQHMKEKQHWALGPFNPLKVPEKSSCGSRHYCLEWLDKQEMNSVLYVSFVTTTTMGDEQIQELAIGLRRSNQKFIWVLRDADTGDVFNGEVRRPELPKGYQDSVKDKGLVVRDWAPQLEILAHPAIGGFVSHCGWNSCMESITMGVPIGAWPVHSDQPRNAVLITKLLKLGITIKDWARRDEVVTAAVVEDAVKRLMASKEGDEIRKRAAEVSGAVRQSVAEGEVYRKEWDSFITHIIR

SEQ ID NO: 933 - protein, 195 aa, Gossypium hirsutum
MEGDDVDMAAAESTEADLDDMKKRLKEMEEEAAALREMQAKVEKEMGSVQDPAAAAATSQANREEVDSRSVFVGNVDYSCTPEEVQQHFQTCGTVNRVTIRADKYGQPKGYAYVEFVEAEAVQEALLLNESELHGRQLKVTAKRTNIPGMKQYRPRRSNPFMRPRGPFMAPYFFAPYGYGKVPRLRMATRYSPYY

SEQ ID NO: 934 - protein, 315 aa, Gossypium hirsutum
MDSLGPNRFDIFEIYRRFCELRTGYEHVCDGEGYRQGEESQRAKFTRDALNQLLKMVESRMRERHMNAIFDELLKLMLQLDLMVDFSVFSCFYDFVFFVCRENGQKNITVSRAVAAWRLVLAGRFRLLNQWCDFVEKNQRHNISEDTWQQVLAFSRCVHETLEGYDPEGAWPVLIDDFVEHMYRISGSNKDTNGFCSYGDSGSQLCAYDDSLPGLKLVPGLKRKLRECNNDKMESLEPLFSSSPNPNCTSNSKRRFILCRSDEREDNLPQNSCDESMEIVKQSSPVGSSKSPCAVEGCMSKGLAGLLSCCSYFAV

SEQ ID NO: 935 - protein, 102 aa, Gossypium hirsutum
MSSFTFVPTACVYGSSWTDWCRIFACTKPNGPLEFMLCLPAHGAVIGAWFGAWPMPLDWERPWQDWPICVSYGAMAGYVVGMVGSFGLALIMHTGRKQLKAE

SEQ ID NO: 936 - protein, 160 aa, Gossypium hirsutum
MAAAAHIDIEPAIPEEETTSNSLIRNTRCCFCFPCFSSRRTPAVGLAFWQRIGSSHVRSNTGFWSSSVRAFKKVREWSEIVAGPRWKTFIRRFNRSKSGSGIVSSGRHGQFHYDPLSYALNFDEGPRQNGNLEDDNDFGAFRAFSTRYASVPGSEKTTLA

SEQ ID NO: 937 - protein, 276 aa, Gossypium hirsutum
MGNQKQKWTAEEEEALLAGITKHGPGKWKNILKDPEFAPFLTHRSNIDLKDKWRNLSVSTSTQGARDKSRAPKVKAIVASLPNTPNSSAPVALRAHNVTSDTVVGDSSNNGIDGKNAPRYNTMIFEALSTIKDTNGCDISAIVSYIEQRHEVPPNFRRLLSSRLRRLVSQGKLEKVQNCYKIREDTLMGTETPTPKQKDVRLRQNSGAIGSGETVEEAAITTAYKVAEAENKSFLAAEAVKEAERVSKMAEDTDSMLQLVKEIYEQCSRGETVILV

SEQ ID NO: 938 - protein, 68 aa, Gossypium hirsutum
MVCFCFLVDQRHMLMSSKPAAGTCLRCRSGASVGLMKTVTRFCYVPIYWKSWKAIICTFCGAVLKSYR

SEQ ID NO: 939 - protein, 177 aa, Gossypium hirsutum
MGLAAALLFLLLAAPAAFAEQYTVGDSSGWTSTGDYQSWVQGKTFTVGDTLLFTYGGSHSVEEVSKSDYDNCNTGNAIKSYSDGNTVITLSNPGAMYFICPTIGHCAGGMKLAINVVAASGNSPSTPSTPSGSTTPSGTPPSGGTTTSPPSTPSGAPSTVNYGFMVALLGAVVGIMC

What is claimed is:

1. An isolated polynucleotide comprising a nucleic acid sequence encoding a polypeptide having the amino acid sequence set forth in SEQ ID NO: 927.

2. The isolated polynucleotide of claim 1, wherein said nucleic acid sequence is set forth in SEQ ID NO: 910.

3. A nucleic acid construct comprising the isolated polynucleotide of claim 1 and at least one cis-acting regulatory element operably linked to said isolated polynucleotide.

4. A plant cell comprising the nucleic acid construct of claim 3.

5. A method of increasing biomass, vigor, yield, abiotic stress tolerance, fiber quality or fiber yield of a plant, the method comprising expressing an exogenous polynucleotide sequence in the plant, said exogenous polynucleotide sequence being the isolated polynucleotide of claim 1, thereby increasing the biomass, vigor, yield, abiotic stress tolerance, fiber quality or fiber yield of the plant.

6. A method of increasing biomass, vigor, yield, abiotic stress tolerance, fiber quality or fiber yield of a plant, the method comprising expressing the nucleic acid construct of claim 3 in the plant, thereby increasing the biomass, vigor, yield, abiotic stress tolerance, fiber quality or fiber yield of the plant.

7. The nucleic acid construct of claim 3, wherein said cis-acting regulatory element is at least 95% identical to the nucleic acid sequence set forth in SEQ ID NO:851, 848, 857, or 854.

8. The nucleic acid construct of claim 3, wherein said cis-acting regulatory element is set forth in SEQ ID NO:851, 848, 857, or 854.

9. The plant cell of claim 4, wherein said cis-acting regulatory sequence is heterologous to said plant cell.

10. The method of claim 5, wherein said expressing said exogenous polynucleotide is effected by transforming or transfecting said plant with said polynucleotide.

* * * * *